(12) United States Patent
Gottwein et al.

(10) Patent No.: US 8,772,022 B2
(45) Date of Patent: *Jul. 8, 2014

(54) HEPATITIS C VIRUS EXPRESSING REPORTER TAGGED NS5A PROTEIN

(75) Inventors: Judith M. Gottwein, Frederiksberg C (DK); Troels Kasper Hoyer Scheel, Copenhagen (DK); Jens Bukh, Praesto (DK); Jannick Prento, Bronshoj (DK); Tanja Bertelsen Jensen, Frederiksberg C (DK); Jacob Bo Lademann, Copenhagen S (DK); Yiping Li, Hvidovre (DK)

(73) Assignees: Hvidovre Hospital, Hvidovre (DK); Kobenhavns Universitet, Copenhagen K (DK)

( * ) Notice: Subject to any disclaimer, the term of this patent is extended or adjusted under 35 U.S.C. 154(b) by 142 days.

This patent is subject to a terminal disclaimer.

(21) Appl. No.: 13/121,565

(22) PCT Filed: Oct. 5, 2009

(86) PCT No.: PCT/DK2009/050263
§ 371 (c)(1),
(2), (4) Date: Sep. 19, 2011

(87) PCT Pub. No.: WO2010/037403
PCT Pub. Date: Apr. 8, 2010

(65) Prior Publication Data
US 2012/0003741 A1    Jan. 5, 2012

Related U.S. Application Data

(60) Provisional application No. 61/102,772, filed on Oct. 3, 2008.

(30) Foreign Application Priority Data

Jan. 2, 2009   (DK) .................................. 2009 00006

(51) Int. Cl.
| | | |
|---|---|---|
| C12N 15/00 | (2006.01) | |
| C12N 15/64 | (2006.01) | |
| C12N 7/00 | (2006.01) | |
| C12N 7/01 | (2006.01) | |
| C12N 5/00 | (2006.01) | |
| A61K 39/29 | (2006.01) | |

(52) U.S. Cl.
USPC .................. 435/320.1; 435/91.4; 435/235.1; 435/325; 424/189.1; 424/228.1

(58) Field of Classification Search
None
See application file for complete search history.

(56) References Cited

U.S. PATENT DOCUMENTS

| | | |
|---|---|---|
| 5,428,145 A | 6/1995 | Okamoto et al. |
| 6,638,714 B1 | 10/2003 | Linnen et al. |
| 7,674,612 B2 | 3/2010 | Rice et al. |
| 7,935,676 B2 | 5/2011 | Wakita et al. |
| 2007/0073039 A1 | 3/2007 | Chisari |
| 2010/0093841 A1 | 4/2010 | Gottwein et al. |
| 2010/0158948 A1 | 6/2010 | Scheel et al. |
| 2010/0278865 A1 | 11/2010 | Wakita et al. |
| 2010/0291545 A1 | 11/2010 | Wakita et al. |
| 2011/0021611 A1 | 1/2011 | Jensen et al. |
| 2011/0045020 A1 | 2/2011 | Akazawa et al. |
| 2011/0059512 A1 | 3/2011 | Gottwein et al. |
| 2011/0059513 A1 | 3/2011 | Scheel et al. |
| 2011/0092688 A1 | 4/2011 | Wakita et al. |
| 2011/0294195 A1 | 12/2011 | Gottwein et al. |
| 2012/0003714 A1 | 1/2012 | Hoelke et al. |
| 2012/0003719 A1 | 1/2012 | Prento et al. |

FOREIGN PATENT DOCUMENTS

| | | |
|---|---|---|
| EP | 1801209 A1 | 6/2007 |
| EP | 1930416 A1 | 6/2008 |
| WO | 9904008 A2 | 1/1999 |
| WO | 0121807 A1 | 3/2001 |
| WO | 02052015 A2 | 7/2002 |
| WO | 02059321 A2 | 8/2002 |
| WO | 2004/104198 A1 | 12/2004 |
| WO | 2005047463 A2 | 5/2005 |
| WO | 2005053516 A2 | 6/2005 |
| WO | 2006096459 A2 | 9/2006 |

(Continued)

OTHER PUBLICATIONS

Simmonds et al, Consensus Proposals for a Unified System of Nomenclature of Hepatitis C Virus Genotypes, Hepatology, 2005. 42(4):962-973.*

(Continued)

*Primary Examiner* — Maria Leavitt
*Assistant Examiner* — Kimberly A Aron
(74) *Attorney, Agent, or Firm* — Thompson Coburn LLP; Charles P. Romano

(57) ABSTRACT

Hepatitis C reporter viruses containing Core through NS2 of prototype isolates of all major HCV genotypes and the remaining genes of isolate JFH1, by insertion of reporter genes in domain III of HCV NS5A were developed. A deletion upstream of the inserted reporter gene sequence conferred favorable growth kinetics in Huh7.5 cells to these viruses. These reporter viruses can be used for high throughput analysis of drug and vaccine candidates as well as patient samples. JFH1-based intergenotypic recombinants with genotype specific homotypic 5'UTR, or heterotypic 5'UTR (either of genotype 1a (strain H77) or of genotype 3a (strain S52)) were also developed. The present inventors additionally developed J6/JFH1 recombinants with the 5'UTR of genotypes 1-6. These recombinants with different 5'UTRs are a useful to study the function of the 5'UTR in a genotype specific manner.

14 Claims, 21 Drawing Sheets

(56) References Cited

FOREIGN PATENT DOCUMENTS

| WO | 2007037429 A1 | 4/2007 |
|---|---|---|
| WO | 2007041487 A2 | 4/2007 |
| WO | 2007073039 A1 | 6/2007 |
| WO | 2008125117 | 10/2008 |
| WO | 2008125119 | 10/2008 |
| WO | 2008141651 | 11/2008 |
| WO | 2008141651 A1 | 11/2008 |
| WO | 2009080052 | 7/2009 |
| WO | 2009080053 | 7/2009 |
| WO | 2010017818 | 2/2010 |
| WO | 2010017819 | 2/2010 |
| WO | 2011/118743 A1 | 9/2011 |

OTHER PUBLICATIONS

Tellinghuisen et al., Identification of Residues Required for RNA Replication in Domains II and III of the Hepatitis C Virus NS5A Protein. Journal of Virology, Feb. 2008. 1073-1083. Published online Nov. 21, 2007.*

Kato et al, Hepatitis C Virus JFH-1 Strain Infection in Chimpanzees Is Associated with Low Pathogenicity and Emergence of an Adaptive Mutation. Hepatology, 2008. 48(3) 732-740.*

Jones et al, "Hepatitis C Virus p7 and NS2 Proteins Are Essential for Production of Infectious", Virus. J Virol, 2007, pp. 8374-8383, vol. 81.

Kim et al., "Monitoring the Antiviral Effect of Alpha Interferon on Individual Cells", Journal of Virology, May 2007, pp. 8814-8820, vol. 81, No. 16.

Koutsoudakis et al, "Characterization of the Early Steps of Hepatitis C Virus Infection by Using Luciferase Reporter Viruses", J Virol, 2006, pp. 5308-5320, vol. 80.

Moradpour et al, "Insertion of Green Fluorescent Protein into Nonstructural Protein 5A Allows Direct Visualization of Functional Hepatitis C Virus Replication Complexes", Journal of Virology, Jul. 2004, pp. 7400-7409, vol. 78, No. 14, The American Society for Microbiology, US.

Schaller et al., "Analysis of Hepatitis C Virus Superinfection Exclusion by Using Novel Fluorochrome Gene-tagged Viral Genomes", Journal of Virology, Feb. 2007, pp. 4591-4603, vol. 81, No. 9.

Tscherne et al, "Time and Temperature-Dependent Activation of Hepatitis C Virus for Low-pH-Triggered Entry", J Virol, 2006, pp. 1734-1741, vol. 80.

Han et al., "Compensatory Mutations in NS3 and NS5A Proteins Enhance the Virus Production Capability of Hepatitis C Reporter Virus", Virus Research, 2009, pp. 63-73, vol. 145, Elsevier B.V.

Masaki et al., "Interaction of Hepatitis C Virus Nonstructural Protein 5A with Core Protein Is Critical for the Production of Infectious Virus Particles", Journal of Virology, Aug. 2008, pp. 7964-7976, vol. 82, No. 16, American Society for Microbiology.

Appel et al, "Mutational Analysis of Hepatitis C Virus Nonstructural Protein 5A: Potential Role of Differential Phosphorylation in RNA Replication and Identification of a Genetically Flexible Domain", Journal of Virology, Mar. 2005, pp. 3187-3194, vol. 79, No. 5, The American Society for Microbiology, US.

Kaul et al., "Cell Culture Adaption of Hepatitis C Virus and in vivo Viability of an Adapted Varient", Journal of Virology, Dec. 2007, pp. 13168-13179, vol. 81, No. 23, The American Society for Microbiology, US.

Krieger et al., "Enhancement of Hepatitis C Virus RNA Replication by Cell Culture-Adaptive Mutations", Journal of Virology, May 2001, pp. 4614-4624, vol. 75, No. 10, The American Society for Microbiology, US.

Scheel et al., "Development of JFH1-based Cell Culture Systems for Hepatitis C Virus Genotype 4a and Evidence for Cross-Genotype Neutralization", Proceedings of the National Academy of Science of USA, Jan. 22, 2008, pp. 997-1002, vol. 105, No. 3, National Academy of Science, Washington D.C., US.

Gottwein et al., "Novel Chimeric Cell Culture System for Hepatitis C Genotypes 1A, 1B, 3A and 4A", Annual Meeting of the European Association for the Study of the Liver, Apr. 2007, pp. S30, vol. 46, No. Suppl.

Gottwein et al., "Robust Hepatitis C Genotype 3a Cell Culture Releasing Adapted Intergenotypic 3a/2a (S52/JFH1) Viruses", Gastroenterology, Nov. 2007, pp. 1614-1626, vol. 133, No. 5, Elsevier, Philadelphia, PA.

Graham et al., "A Genotype 2b NS5B Polymerase with Novel Substitutions Supports Replication of a Chimeric HCV 1b: 2b Replicon Containing a Genotype 1b NS3-5A Background", Antiviral Research, Jan. 2006, pp. 24-30, vol. 69, No. 1, Elsevier Science BV., Amsterdam, NL.

Kato et al., "Efficient Replication of the Genotype 2a Hepatitis C Virus Subgenomic Replicon", Gastroenterology, Dec. 2003, pp. 1808-1817, vol. 125, No. 6, Elsevier, Philadelphia, PA.

Lohmann et al., "Mutation in Hepatitis C Virus RNAs Conferring Cell Culture Adaptation", Journal of Virology, Feb. 2001, pp. 1437-1449, vol. 75, No. 3, The American Society for Microbiology, US.

Pietschmann et al., "Construction and Characterization of Infectious Intragenotypic and Intergenotypic Hepatitis C Virus Chimeras", Proceedings of the National Academy of Science of USA, May 9, 2006, pp. 7408-7413, vol. 103, No. 19, National Academy of Science, Washington D.C.

Wakita et al., "Production of Infectious Hepatitis C Virus in Tissue Culture from a Cloned Viral Genome", Nature Medicine, Jul. 2005, pp. 791-796, vol. 11, No. 7, Nature Publishing Group, New York, NY.

Yanagi et al., "Transcripts of a Chimeric cDNA Clone of Hepatitis C Virus Genotype 1b are Infectious in vivo", Virology, Jan. 1, 1998, pp. 161-172, vol. 244, No. 1.

Yi et al., "Compensatory Mutations in E1, p7, NS2, and NS3 Enhance Yields of Cell Culture-Infectious Intergenotypic Chimeric Hepatitis C Virus", Journal of Virology, Jan. 2007, pp. 629-638, vol. 81, No. 2, American Society for Microbiology, US.

Sakai et al, "In Vivo Study of the HC-TN Strain of Hepatitis C Virus Recovered from a Patient with Fulminant Hepatitis: TNA Transcripts of a Molecular Clone (pHC-TN) are Infectious in Chimpanzees but Not in Huh7.5 Cells", Journal of Virology, Jul. 2007, pp. 7208-7219, vol. 81, No. 13, American Society for Microbiology.

Gottwein et al., "Cutting the Gordian Knot—Development and Biological Relevance of Hepatitis C Virus Cell Culture Systems", Advances in Virus Research, 2008, pp. 51-133, vol. 71.

International Preliminary Report on Patentability for PCT/DK2008/050333 dated Mar. 29, 2010.

International Search Report and Written Opinion of the International Searching Authority dated Nov. 3, 2009 for PCT Application No. PCT/DK2008/050332.

Hui et al., "Interferon and Ribavirin Therapy for Chronic Hepatitis C Virus Genotype 6: A Comparison with Genotype 1", Article, Apr. 1, 2003, pp. 1071-1074, vol. 87.

GenBank Accession No. AB047639.1, HCV JFH1 complete genomic RNA, Nov. 12, 2005.

GenBank Accession No. Y12083.1, HCV genotype 6a RNA for HCV polyprotein, Nov. 10, 2005.

Kato et al., "Sequence Analysis of Hepatitis C Virus Isolated From a Fulminant Hepatitis Patient", Journal of Medical Virology, 2001, pp. 334-339, vol. 64.

"Written Description Training Materials", United States Patent and Trademark Office, Department of Commerce, Mar. 2008, pp. 1-84, Revision 1 (part 2).

Gottwein et al., "Development and Characterization of Hepatitis C Virus Genotype 1-7 Cell Culture Systems: Role of CD81 and Scavenger Receptor Class B Type I and Effect of Antiviral Drugs", Hepatology, Oct. 2008, pp. 364-377, vol. 49, No. 2.

Lindenbach et al., "Complete Replication of Hepatitis C Virus in Cell Culture", Science, Jul. 2005, pp. 623-626, vol. 309, No. 5734, American Association for the Advancement of Science, Washington D.C.

Murphy et al., "A New Genotype of Hepatitis C Virus Originating from Central Africa", Hepatology, Oct. 2007, pp. 623A, vol. 46, No. 4, Suppl.S.

Zhong et al., "Robust Hepatitis C Virus Infection in vitro", Proceedings of the National Academy of Sciences, 2005, pp. 9294-9299, vol. 102, No. 26.

(56) References Cited

OTHER PUBLICATIONS

Appel et al., "Essential Role of Domain III of Nonstructural Protein 5A for Hepatitis C Virus Infectious Particle Assembly", PLOS Pathogens, Mar. 2008, pp. 1-14, vol. 4, Issue 3.

Bukh et al, "Mutations That Permit Efficient Replication of Hepatitis C Virus RNA in Huh-7 Cells Prevent Productive Replication in Chimpanzees", Proc. Natl. Acad. Sci., Oct. 29, 2002, pp. 14416-14421, vol. 99, No. 22.

Chamberlain et al., "Complete Nucleotide Sequence of a Type 4 Hepatitis C Virus Variant, the Predominant Genotype in the Middle East", Journal of General Virology, 1997, pp. 1341-1347, vol. 78.

Forns et al., "Hepatitis C Virus Lacking the Hypervariable Region 1 of the Second Envelope Protein is Infectious and Causes Acute Resolving or Persistent Infection in Chimpanzees", Proceedings of the National Academy of Sciences of the United States of America, Nov. 21, 2000, pp. 13318-13323, vol. 97, No. 24.

Gottwein et al., "Monocistronic Hepatitis C Reporter Virus Recombinants of All Major Genotypes Expressing Enhanced Green Fluorescent Protein Tagged NS5A Protein", Journal of Hepatology, Apr. 2009, p. S33, vol. 50, No. sup1.

Hou et al., "A Recombinant Replication-Competent Hepatitis C Virus Expressing Azami-Green, a Bright Green-Emitting Fluorescent Protein, Suitable for Visualization of Infected Cells", Biochemical and Biophysical Research Communications, Sep. 9, 2008, pp. 7-11, vol. 377, No. 1.

Jensen et al., "Highly Efficient JFH1-Based Cell-Culture System for Hepatitis C Virus Genotype 5a: Failure of Homologous Neutralizing-Antibody Treatment to Control Infection", Journal of Infectious Diseases, Dec. 15, 2008, pp. 1756-1765, vol. 198.

Jensen, "Efficient Cell Culture System for Hepatitis C Virus Genotype 5a", Department of Infectious Diseases and Clinical Research Unit, Copenhagen University Hospital, Master Thesis, Mar. 2007, pp. 1-60.

Prentoe et al., "HCV Entry Related Studies", Booklet, 4th Smogen Summer Symposium on Virology, Aug. 2008, p. 23.

Schaller et al., "Analysis of Hepatitis C Virus Superinfection Exclusion by Using Novel Fluorochrome Gene-Tagged Viral Genomes", Journal of Virology, May 2007, pp. 4591-4603, vol. 81, No. 9.

Suzuki et al., "Novel Chimeric Hepatitis C Virus Genome Comprising Nucleic Acid Encoding Epitope Tag Peptide at Hypervariable Region 1 of E2 Protein, Useful as Vaccine for Preventing or Treating Hepatitis-C Viral Infection", Database WPI Week 200914, Thomson Scientific, AN 2009-E03534, Jan. 22, 2009.

International Preliminary Report on Patentability (Chapter II) for PCT/DK20081050113 issued May 25, 2009.

"Written Description Training Materials", United States Patent and Trademark Office, Department of Commerce, Mar. 2008, pp. 1-84, Revision 1 (Part 1).

International Search Report and Written Opinion for PCT/DK2009/050193 dated Oct. 30, 2009.

Murphy, "Hepatitis C Virus Isolate QC69 Polyprotein Gene, Complete CDs", Database EMBL E.B.I. Hinxton U.K., Nov. 2007, XP002520134 Database Accession No. EF108306.

Ikeda et al., "Selectable Subgenomic and Genome-Length Dicistronic RNAs Derived from an Infectious Molecular Clone of the HCV-N Strain of Hepatitis C Virus Replicate Efficiently in Cultured Huh7 Cells", Journal of Virology, Mar. 2002, pp. 2997-3006, vol. 76, No. 6.

Pietschmann et al., "Production of Infectious Genotype 1 b Virus Particles in Cell Culture and Impairment by Replication Enhancing Mutations", PLOS Pathogens, Jun. 2009, pp. 1-14, vol. 5 No. 6.

Scheel et al., "Analysis of Functional Differences between Hepatitis C Virus NS5A of Genotypes 1-7 in Infectious Cell Culture Systems", PLOS Pathogens, May 2012, pp. 1-16, vol. 8 No. 5.

Gottwein et al., "Development and Application of Hepatitis C Reporter Viruses with Genotype 1 to 7 Core-Nonstructural Protein 2 (NS2) Expressing Fluorescent Proteins or Luciferase in Modified JFH1 NS5A", Journal of Virology, Sep. 2011, pp. 8913-8928, vol. 85 No. 17.

\* cited by examiner

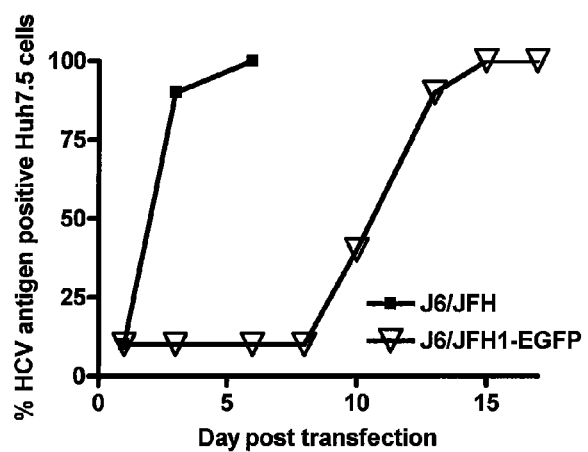
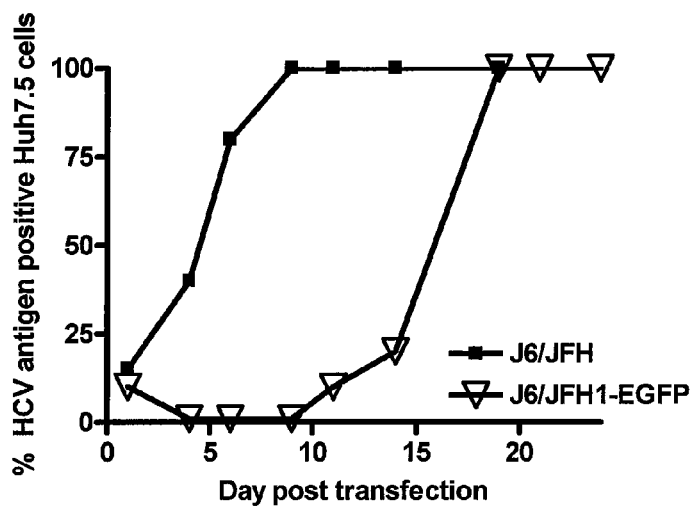
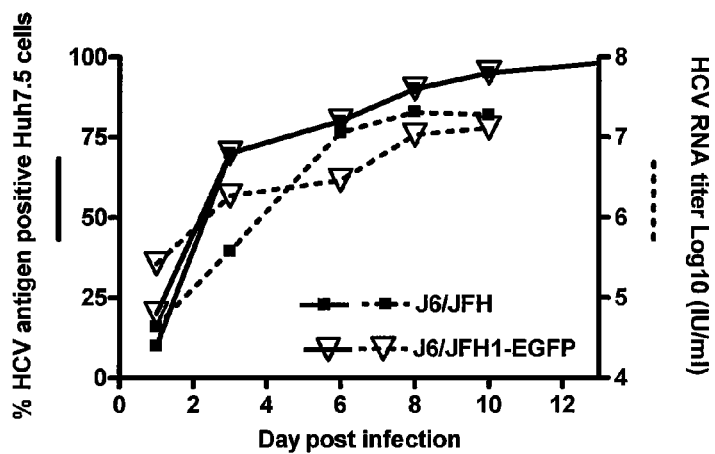
Fig. 1

A
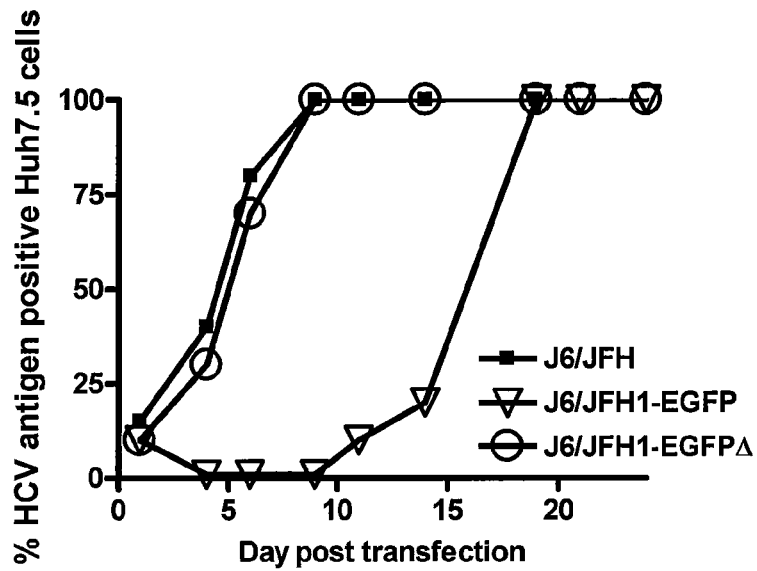
B
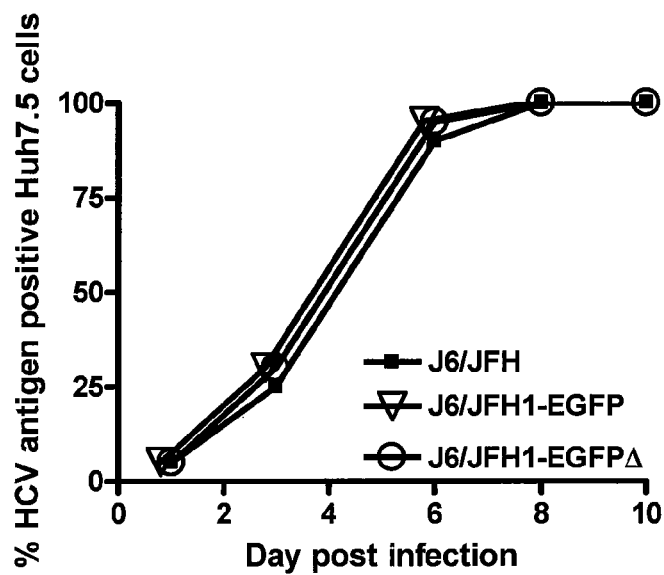
Fig. 2

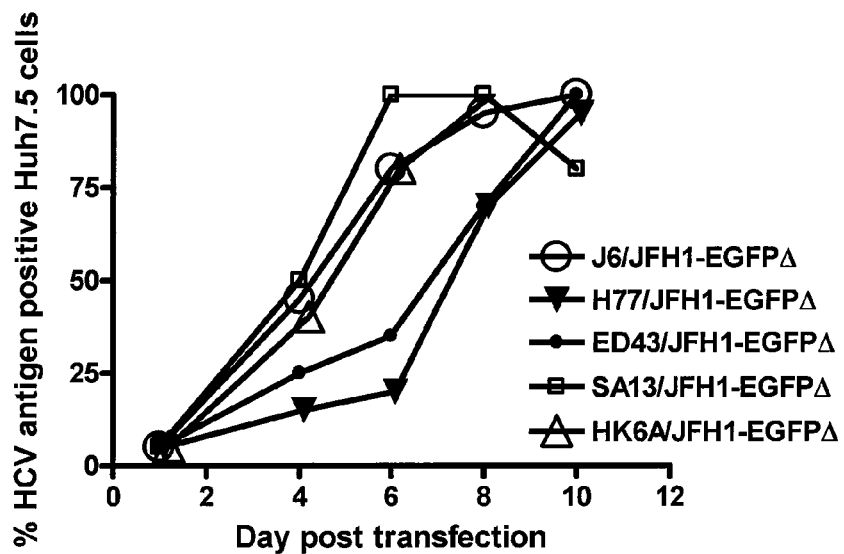
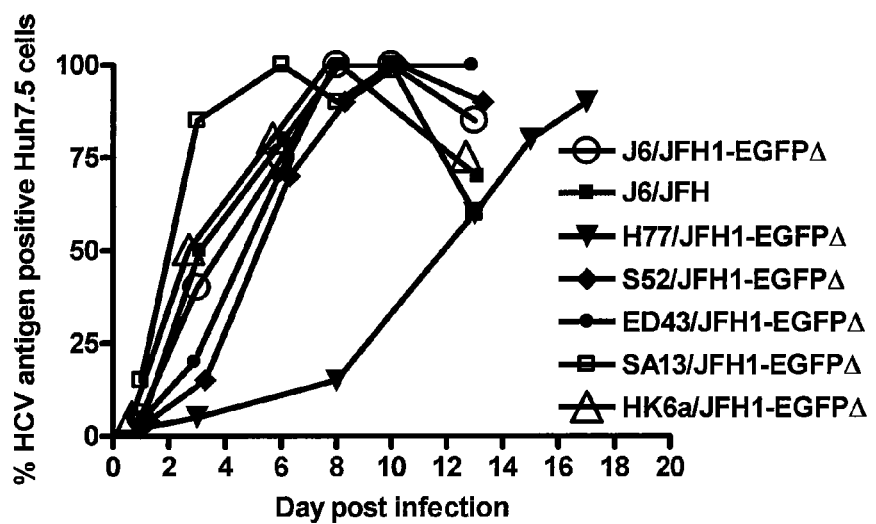
Fig. 3

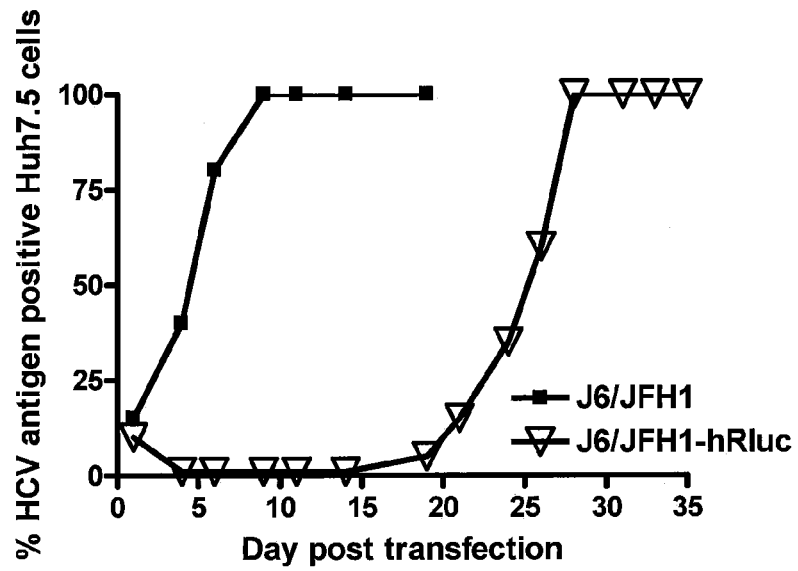
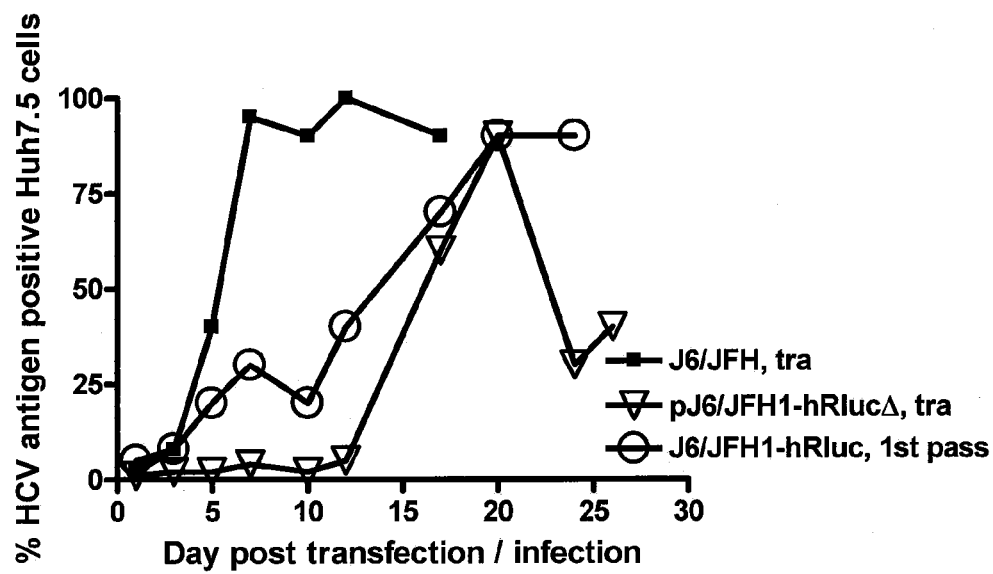
Fig. 4

Fig. 8a & b

| Virus | RNA titer (Log10(IU/mL)) | | | | | Infectivity titer (Log10(FFU/mL)) | | | | |
|---|---|---|---|---|---|---|---|---|---|---|
| | Day 1 | Day 3 | Day 5 | Day 7 | Day 9 | Day 1 | Day 3 | Day 5 | Day 7 | Day 9 |
| J6/JFH | 5.6 | 5.8 | 7.5 | 8.2 | 7.4 | 1.8 | 3.1 | 4.3 | 4.6 | 4.2 |
| J6$^{5UTR-NS2}$/JFH1 | 6.0 | 5.9 | 7.5 | 7.7 | 7.6 | 2.0 | 3.1 | 4.4 | 4.6 | 4.3 |
| H77$^{5UTR}$/J6$^{C-NS2}$/JFH1 | 6.2 | 5.7 | 7.3 | 8.1 | 7.9 | 1.8 | 2.5 | 4.0 | 4.7 | 4.3 |
| S52$^{5UTR}$/J6$^{C-NS2}$/JFH1 | 6.4 | 5.8 | 7.3 | 8.2 | 8.0 | 1.8 | 3.1 | 4.1 | 4.3 | 4.2 |
| S52/JFH1$_{T2718G, A4550C}$ | 5.8 | 6.2 | 7.9 | 8.4 | 8.0 | 1.1 | 3.4 | 4.5 | 4.6 | 4.1 |
| H77$^{5UTR}$/S52$^{C-NS2}$/JFH1$_{T2719G, A4551C}$ | 5.7 | 5.7 | 7.3 | 8.4 | 8.3 | 1.2 | 2.5 | 3.8 | 4.5 | 4.3 |
| S52$^{5UTR-NS2}$/JFH1$_{T2717G, A4549C}$ | 6.0 | 6.2 | 8.0 | 8.4 | 8.2 | 1.6 | 3.2 | 4.4 | 4.6 | 4.2 |

Fig. 17

| Virus | Genotype | | Transfection | | First passage | | | Mutation | | |
|---|---|---|---|---|---|---|---|---|---|---|
| | 5'UTR-C-NS2 | C-NS2 | Day (p.t.) | % infected cells | MOI | Day (p.i.) | % infected cells | 5'UTR[§] | C-3'UTR | |
| H77[5'UTR-NS2]/JFH1[T2701C,A4081T] | 1a | 1a | 5 | 90 | 0.01 | 10 | 85 | G1A | No | |
| J4[5'UTR-NS2]/JFH1[T2997C,A4828T] | 1b | 1b | 8 | 85 | 0.002 | 15 | 90 | G1A | No | |
| J6[5'UTR-NS2]/JFH1, Exp. 1 | 2a | 2a | 7 | 95 | 0.003 | 7 | 90 | No | NS2, NS3[#] | |
| J6[5'UTR-NS2]/JFH1, Exp. 2 | 2a | 2a | 8 | 90 | 0.006 | 5 | 80 | No | No | |
| J8[5'UTR-NS2]/JFH1, Exp. 1 | 2b | 2b | 8 | 80 | 0.003 | 9 | 80 | G1A | NS2, NS3[¤] | |
| J8[5'UTR-NS2]/JFH1, Exp. 2 | 2b | 2b | 7 | 90 | ND | 10 | 90 | G1A | No | |
| S52[5'UTR-NS2]/JFH1[T2717G,A4549C] | 3a | 3a | 8 | 95 | 0.003 | 7 | 90 | G1A | No | |
| ED43[5'UTR-NS2]/JFH1[A2819G,A3269T] | 4a | 4a | 5 | 90 | 0.015 | 11 | 80 | No | No | |
| SA13[5'UTR-NS2]/JFH1[C3404G,A3695G] | 5a | 5a | 5 | 90 | 0.06 | 5 | 90 | No | No | |
| HK6a[5'UTR-NS2]/JFH1[T1391C,A1592C], Exp. 1 | 6a | 6a | 5 | 90 | 0.020 | 8 | 90 | G1A | E2, NS2, NS5A[¢] | |
| HK6a[5'UTR-NS2]/JFH1[T1391C,A1592C], Exp. 2 | 6a | 6a | 7 | 90 | ND | 8 | 90 | G1A | No | |
| H77[5'UTR]/S52[C-NS2]/JFH1[T2719G,A4551C] | 1a | 3a | 8 | 95 | 0.003 | 7 | 90 | G1A | No | |
| S52[5'UTR]/J6[C-NS2]/JFH1 | 3a | 2a | 8 | 95 | 0.003 | 7 | 90 | G1A | No | |
| S52[5'UTR]/SA13[C-NS2]/JFH1[C3404G,A3695G] | 3a | 5a | 8 | 95 | 0.015 | 11 | 80 | G1A | No | |

Fig. 19

| Virus | RNA titer (Log10(IU/mL)) | | | | | Infectivity titer (Log10(FFU/mL)) | | | | |
|---|---|---|---|---|---|---|---|---|---|---|
| | Day 1 | Day 3 | Day 5 | Day 7 | Day 9 | Day 1* | Day 3 | Day 5 | Day 7 | Day 9 |
| H77$^{5'UTR}$/J6$^{C-NS2}$/JFH1 | 6.0 | 5.2 | 6.1 | 7.5 | 7.8 | 0 | 2.1 | 3.3 | 4.3 | 4.9 |
| J4$^{5'UTR}$/J6$^{C-NS2}$/JFH1 | 6.2 | 5.1 | 6.1 | 7.2 | 7.7 | 0 | 2.2 | 3.2 | 4.3 | 4.9 |
| J6/JFH | 5.9 | 5.5 | 6.3 | 7.3 | 7.9 | 0 | 2.4 | 3.7 | 4.7 | 4.9 |
| J6$^{5'UTR-NS2}$/JFH1 | 6.1 | 5.6 | 6.4 | 7.4 | 7.8 | 0 | 2.5 | 3.7 | 4.6 | 4.8 |
| J8$^{5'UTR}$/J6$^{C-NS2}$/JFH1 | 6.0 | 5.2 | 6.5 | 7.7 | 7.6 | 0 | 2.4 | 3.5 | 4.5 | 4.9 |
| S52$^{5'UTR}$/J6$^{C-NS2}$/JFH1 | 6.1 | 5.3 | 6.1 | 7.4 | 7.7 | 0 | 2.3 | 3.4 | 4.4 | 4.7 |
| ED43$^{5'UTR}$/J6$^{C-NS2}$/JFH1 | 6.3 | 5.1 | 6.4 | 7.1 | 7.8 | 0 | 2.1 | 3.2 | 4.3 | 4.9 |
| SA13$^{5'UTR}$/J6$^{C-NS2}$/JFH1 | 6.0 | 5.2 | 5.9 | 7.3 | 7.8 | 0 | 2.1 | 3.1 | 4.2 | 4.8 |
| HK6a$^{5'UTR}$/J6$^{C-NS2}$/JFH1 | 5.8 | 5.0 | 6.6 | 7.5 | 7.7 | 0 | 2.3 | 3.5 | 4.5 | 4.8 |

HEPATITIS C VIRUS EXPRESSING REPORTER TAGGED NS5A PROTEIN

CROSS-REFERENCE TO RELATED APPLICATIONS

The present application is a National Stage application of International Patent Application No. PCT/DK2009/050263, filed Oct. 5, 2009, which is incorporated herein by reference in its entirety and which claims the benefit of Denmark Application No. PA 200900006, filed Jan. 2, 2009, and U.S. Application Ser. No. 61/102,772; filed Oct. 3, 2008.

TECHNICAL FIELD OF THE INVENTION

Incorporation of Sequence Listing

A computer readable form of the Sequence Listing named "66146_95720_SEQ_LST.txt" and which is 2,798,124 bytes in size, is electronically filed herewith and incorporated herein by reference in its entirety. This Sequence Listing consists of SEQ ID NOs: 1-136.

The present invention relates to Hepatitis C reporter viruses that greatly facilitate detection of the tagged virus. EGFP can easily be detected by fluorescence-based techniques such as fluorescence microscopy, flow cytometry, or by fluorescence plate readers. Luciferase is detected by luminescence based techniques, e.g. in suitable plate readers.

In particular the present invention relates to Hepatitis C reporter virus recombinant expressing reporter tagged NS5A protein. Tagged viruses facilitate high-throughput analysis, as required for screening of new antivirals, immunotherapy and vaccine candidates, for analysis of patient samples, and as a tool for basic research studies.

Background of the Invention

Hepatitis C virus (HCV) is one of the most widespread infectious diseases in the world. About 180 million people are infected with HCV worldwide with a yearly incidence of 3-4 million. While the acute phase of infection is mostly asymptomatic, the majority of acutely infected individuals develops chronic hepatitis and is at increased risk of developing liver cirrhosis and hepatocellular carcinoma. Thus, HCV infection is a major contributor to end-stage liver disease and in developed countries to liver transplantation.

HCV is a small, enveloped virus classified as a member of the Flaviviridae family. Its genome consists of a 9.6 kb single stranded RNA of positive polarity composed of 5' and 3' untranslated regions (UTR) and one long open reading frame (ORF) encoding a polyprotein, which is co- and posttranslationally cleaved and thus yields the structural (Core, E1, E2), p7 and nonstructural (NS2, NS3, NS4A, NS4B, NS5A, NS5B) proteins.

HCV isolates from around the world exhibit significant genetic heterogeneity. At least 6 major HCV genotypes (genotypes 1-6) have been identified, which usually differ in nucleotide and amino acid sequence composition by >30%.

In addition, there are numerous subtypes (a, b, c, etc.), which usually differ by >20% at the nucleotide and deduced amino acid level. In the Western World, genotypes 1a, 1b, and 3a are the most common, but 2a and 2b also show a significant presence. Genotype 3a infects up to 50% of patients in several European countries as well as a high percentage of HCV-infected individuals in many highly populated countries in Asia (e.g., India) and the former Union of Soviet Socialist Republics. In HCV-infected patients, genotype 3 was associated with more pronounced hepatic steatosis. In the Middle East, particularly in Egypt, up to 15% of the population are infected with HCV. From this geographic region HCV genotype 4 constitute about 90% of the cases diagnosed. The high prevalence of HCV genotype 4 and in particular HCV genotype 4a in Egypt was most likely caused by unintended transmission to the population through treatment intervention against schistosomiasis. The prevalence HCV genotype 4 in Western countries has traditionally been low, but in certain European regions this genotype has been shown to be significant mainly among intravenous dug users. At present the incidences continues to increase.

Genotype 5 is found primarily in South Africa, while genotype 6 predominates in Southeast Asia, a region with a high prevalence of HCV. Recently, genotype 7a was discovered in Canadian and Belgian patients, presumably infected in Central Africa. Different HCV genotypes showed different susceptibility to neutralizing antibodies (ntAB) in vitro and differential response rates to treatment in patients.

The only approved therapy for HCV comprises a combination therapy with interferon and ribavirin. Such therapy is expensive and associated with severe side effects and contraindications. Sustained viral response can be achieved in only about 55% of treated patients in general, in 85-90% of patients infected with genotypes 2 and 3 and only in 40-50% of patients infected with genotype 1 and 4. There is no vaccine against HCV.

Tagged viruses facilitate high-throughput analysis, as required for screening of new antivirals, immunotherapy and vaccine candidates, for analysis of patient samples e.g. for ntAB, as well as for basic research studies.

In genotype 1b (strain Con1) replicon systems, two positions in HCV NS5A (immediately downstream of codon 384 and 418, respectively, related to the H77 reference NS5A sequence) were identified, at which GFP could be inserted without significantly impairing replication efficiency (Moradpour et al., 2004). The replicon system does not provide a model for the complete viral life cycle, and GFP yields, in fluorescence based analysis, a significantly weaker signal than EGFP.

After discovery of the ability of strain JFH1 to go through the full viral life cycle in Huh7 and derived cell lines, GFP and *Renilla* luciferase was inserted in JFH1 NS5A at the position previously identified in the replicon system (immediately downstream of aa 418 related to the JFH1 and the H77 reference NS5A sequence) (Kim et al., 2007). JFH1 shows significantly slower spread kinetics and lower infectivity titers than the intragenotypic recombinant J6/JFH and JFH1-based intergenotypic recombinants used in our invention (Gottwein et al., 2009). Additionally, in this study by Kim et al., GFP- and luciferase-tagged reporter viruses showed significantly lower infectivity titers than JFH1.

Schaller et al. developed J6/JFH1 (C3) (=Jc1 virus) reporter viruses with GFP or RFP (red fluorescent protein) inserted in NS5A (aa 387 related to the H77 reference NS5A sequence) (Schaller et al., 2007). Infectivity titers of these viruses were 50 times lower than that of the untagged virus and the viruses did not spread during 72 hrs after infection of Huh7.5 cells.

Also other reporter insertion sites than NS5A have been investigated. In a report by Jones et al., a monocistronic reporter J6/JFH1 virus expressing *Renilla* luciferase was developed by insertion of this reporter gene between p7 and NS2, but yielded 5-10× lower infectivity titers then J6/JFH1 (Jones et al., 2007).

Tscherne et al. described generation of a monocistronic J6/JFH reporter virus with *Renilla* luciferase inserted after nucleotide 19 of the Core protein without systematically comparing the efficiency of this virus to the untagged virus (Tscherne et al., 2006).

Koutsoudakis et al. developed bicistronic reporter viruses, expressing Firefly luciferase under control of the HCV IRES and JFH1 as well as Con1/JFH1 and J6/JFH viral proteins under control of the EMCV-IRES (Koutsoudakis et al., 2006). In this study, all luciferase-tagged viruses showed delayed spread kinetics and about 3 times lower infectivity titers than the original JFH1. Koutsoudakis also developed a bicistronic reporter virus with Venus-GFP under control of the HCV IRES and J6/JFH1 (C3) (=Jc1) under control of the EMCV-IRES; it was shown that replication of such bicistronic reporter viruses was impaired compared to those of monocistronic reporter viruses.

Even though many strategies have been tried, so far all reporter viruses had impaired viability compared to untagged viruses. Importantly, reporter viruses of recombinants of the different HCV genotypes have not been developed.

SUMMARY OF THE INVENTION

The present inventors surprisingly developed monocistronic reporter viruses of hepatitis C virus. They identified a deletion in NS5A that led to spread kinetics and infectivity titer comparable to those of reference virus J6/JFH1.

Thus, an aspect of the invention relates to a replicating RNA, comprising the structural genes (Core, E1, E2), p7, and the non-structural gene NS2 or at least part of the non-structural gene NS2 of genotype 1a, 1b, 2a, 2b, 3a, 3b, 4a, 4b, 5a, 6a, 6b or 7a and the non-structural genes NS3, NS4A, NS4B, NS5A and NS5B from the JFH1 strain and wherein a reporter gene is inserted in domain III of the non-structural gene NS5A and further comprising a deletion in the non-structural gene NS5A.

Thus, an aspect of the invention relates to a replicating RNA, comprising the structural genes (Core, E1, E2), p7, and the non-structural gene NS2 or at least part of the non-structural gene NS2 of genotype 1a, 1b, 2a, 2b, 3a, 4a, 5a, 6a, or 7a and the non-structural genes NS3, NS4A, NS4B, NS5A and NS5B from the JFH1 strain and wherein a reporter gene is inserted in domain III of the non-structural gene NS5A and further comprising a deletion in the non-structural gene NS5A.

Thus, a further aspect of the invention relates to a replicating RNA, comprising the structural genes (Core, E1, E2), p7, and the non structural gene NS2 or at least part of the non-structural gene NS2 of genotype 1a, 1b, 2a, 2b, 3a, 4a, 5a, 6a, or 7a and the non-structural genes NS3, NS4A, NS4B, NS5A and NS5B, as well as the 5' and 3' UTR from the JFH1 strain and wherein a reporter gene is inserted in domain III of the non-structural gene NS5A and further comprising a deletion in the non-structural gene NS5A.

In another aspect the invention relates to an isolated nucleic acid molecule which encodes human hepatitis C virus expressing EGFP of strain selected from the group consisting of H77/JFH1-EGFPΔ (1a/2a), TN/JFH1-EGFPΔ (1a/2a), J4/JFH1-EGFPΔ (1b/2a), J6/JFH1-EGFPΔ (2a/2a), J8/JFH1-EGFPΔ (2b/2a), S52/JFH1-EGFPΔ (3a/2a), ED43/JFH1-EGFPΔ (4a/2a), SA13/JFH1-EGFPΔ (5a/2a), HK6a/JFH1-EGFPΔ (6a/2a) or QC69/JFH1-EGFPΔ (7a/2a). For nucleic acid sequences, the SEQ ID numbers are SEQ ID NOs: 1, 119, 2, 3, 4, 5, 6, 7, 8, 9. For amino acid sequences, the SEQ ID numbers are SEQ ID NOs: 11, 120, 12, 13, 14, 15, 16, 17, 18, 19.

In another aspect the invention relates to an isolated nucleic acid molecule, which encodes human hepatitis C virus expressing *renilla* luciferase of strains selected from the group consisting of H77/JFH1-hRlucΔ (1a/2a); TN/JFH1-hRlucΔ (1a/2a); J4/JFH1-hRlucΔ (1b/2a); J6/JFH1-hRlucΔ (2a/2a); J8/JFH1-hRlucΔ (2b/2a); S52/JFH1-hRlucΔ (3a/2a); ED43/JFH1-hRlucΔ (4a/2a); SA13/JFH1-RlucΔ (5a/2a); HK6a/JFH1-hRlucΔ (6a/2a); QC69/JFH1-hRlucΔ (7a/2a). For nucleotide acid sequences, the SEQ ID numbers are SEQ ID NOs: 121, 122, 123, 10, 83, 124, 125, 126, 127, 128. For amino acid sequences, the SEQ ID numbers are SEQ ID NOs: 129, 130, 131, 20, 103, 132, 133, 134, 135, 136.

In another aspect the invention relates to an isolated nucleic acid molecule which encodes human hepatitis C virus of strain selected from the group consisting of J6/JFH1-CherryΔ (2a/2a) and J6/JFH1-DSRedΔ (2a/2a). The nucleotide SEQ ID NOs: 78 and 79. The amino acid SEQ ID numbers are SEQ ID NOs: 98 and 99.

In a further aspect the present invention relates to an isolated nucleic acid molecule, wherein said molecule comprises one or more adaptive mutations in Core, E1, E2, p7, NS2, NS3, NS4A, NS4B, NS5A or NS5B singly or in combination. Examples are shown in Table 2.

In yet another aspect the present invention pertains to a composition comprising a nucleic acid molecule according to the present invention, a cassette vector for cloning viral genomes, methods for producing a cell, which replicates the described RNA, and cells obtainable there from.

In another aspect the present invention pertains to methods for producing a hepatitis C virus particle, methods for in vitro producing a hepatitis C virus-infected cell.

In a further aspect the present invention pertains to methods for screening an anti-hepatitis C virus substance, hepatitis C vaccines comprising a hepatitis C virus particle, methods for producing a hepatitis C virus vaccine and antibodies against hepatitis C virus.

BRIEF DESCRIPTION OF THE FIGURES

FIG. 1

Figure 5:
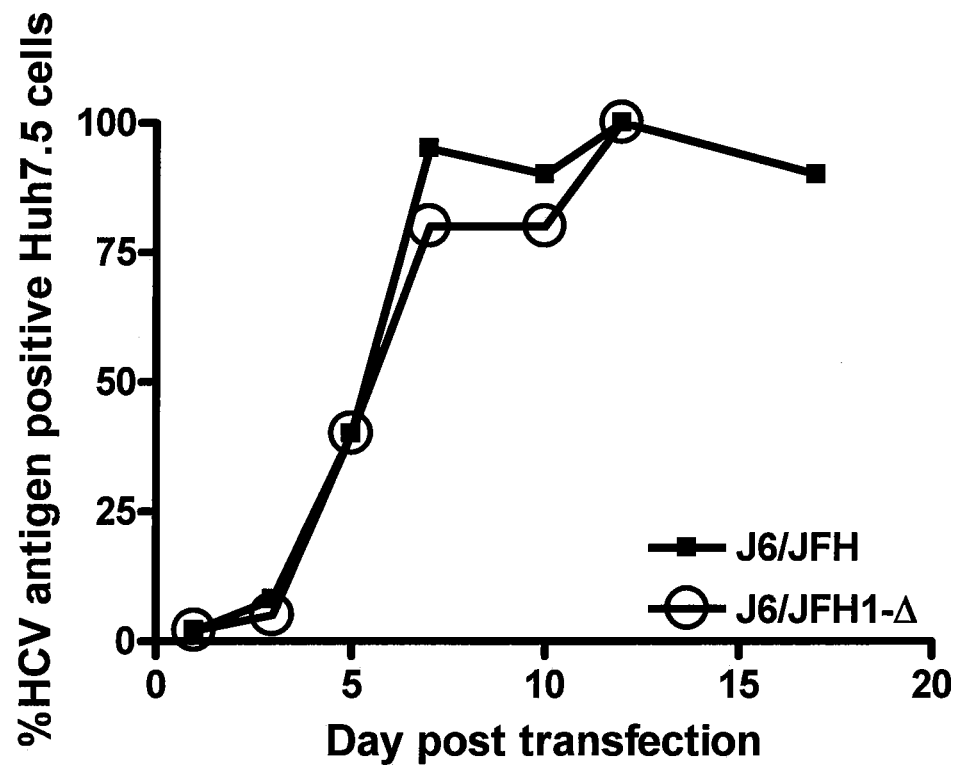

Viability of J6/JFH1-EGFP in Huh7.5 Cells.

(A, B) In two separate experiments, Huh7.5 cells were transfected in parallel with RNA transcripts from pJ6/JFH and pJ6/JFH1-EGFP. (C) For 1st viral passage of J6/JFH and J6/JFH1-EGFP, day 8 and day 15 culture supernatant from transfection (A), containing $10^3$ TCID$_{50}$, was used to infect naive Huh7.5 cells. (A, B, C) After immunostaining, the percentage of HCV antigen positive cells was scored by fluorescence microscopy. (C) Supernatant HCV RNA titers were measured by Real-Time RT-PCR.

FIG. 2

J6/JFH1-EGFPΔ Shows Improved Viability in Huh7.5 Cells.

(A) Huh7.5 cells were transfected in parallel with RNA transcripts from pJ6/JFH, pJ6/JFH1-EGFP and pJ6/JFH1-EGFPΔ (Δ indicates deletion of nt 7016-7135, leading to deletion of JFH1 NS5A aa 250-289). Data from pJ6/JFH, and pJ6/JFH1-EGFP are also shown in FIG. 1B. (B) For 1st viral passage of J6/JFH, J6/JFH1-EGFP and J6/JFH1-EGFPΔ, 0.5 ml day 8, 1 ml day 15 and 1 ml day 9 culture supernatant, respectively, from transfection (A) was used to infect naive Huh7.5 cells. (A, B) After immunostaining, the percentage of HCV antigen positive cells was scored by fluorescence microscopy.

FIG. 3

Viability of Genotype 1-6 EGFP-Reporter Viruses in Huh7.5 Cells.

(A) Huh7.5 cells were transfected in parallel with RNA transcripts from the following constructs: pH77/JFH1 (T2700C,A4080T)-EGFPΔ; pJ6/JFH1-EGFPΔ; pED43/JFH1(A2819G,A3269T)-EGFPΔ; pSA13/JFH1(C3405G, A3696G)-EGFPΔ; and pHK6a/JFH1(T1389C,A1590C)-EGFPΔ. (B) For 1st viral passage 1 ml culture supernatant from transfection (A) was derived at the following days for virus cultures with EGFPΔ viruses with the indicated genotype of Core-NS2: day 6 (SA13), day 8 (J6 and HK6a), and day 10 (H77 and ED43). For S52/JFH1(A4550C)-EGFPΔ, 1 ml supernatant from day 71 of another transfection (data not shown) was used. (A, B) After immunostaining, the percentage of HCV antigen positive cells was scored by fluorescence microscopy.

FIG. 4

Viability of J6/JFH1-hRluc and J6/JFH1-hRlucΔ in Huh7.5 Cells.

(A, B) Huh7.5 cells were transfected in parallel with RNA transcripts from pJ6/JFH and pJ6/JFH1-hRluc. (B) For 1st viral passage (1st pass) of J6/JFH1-hRluc, 1 ml day 31 culture supernatant from transfection (A) was used to infect naive Huh7.5 cells. For transfection (tra), RNA transcripts from pJ6/JFH and pJ6/JFH1-hRlucΔ were used. (A, B) After immunostaining, the percentage of HCV antigen positive cells was scored by fluorescence microscopy.

FIG. 5

J6/JFH1-Δ Does not Show Impaired Viability in Huh7.5 Cells.

Huh7.5 cells were transfected in parallel with RNA transcripts from pJ6/JFH and pJ6/JFH1-Δ. (deletion of nt 7016-7135, leading to deletion of JFH1 NS5A aa 250-289). After immunostaining, the percentage of HCV antigen positive cells was scored by fluorescence microscopy.

FIG. 6

J6/JFH1-Δ is fully viable in Huh7.5 cells: infectivity titers following transfection. Huh7.5 cells were transfected in parallel with RNA transcripts from pJ6/JFH and pJ6/JFH1-Δ. (deletion of nt 7016-7135, leading to deletion of JFH1 NS5A aa 250-289). Percentage of HCV antigen positive cells is shown in FIG. 5. In this Figure, infectivity titers (FFU/ml) during the course of infection are shown. At day 1 and 4, values were below cut-off (1.7 log 10 FFU/ml).

FIG. 7

J6/JFH1-Δ25 Appears Fully Viable in Huh7.5 Cells.

Huh7.5 cells were transfected in parallel with RNA transcripts from pJ6/JFH and pJ6/JFH1-Δ25, with the 25 aa deletion, identified after insertion of EGFP (nt 7065-7139 corresponding to NS5A amino acid position 266 to 290). After immunostaining, the percentage of HCV NS5A positive cells was scored by fluorescence microscopy.

FIG. 8

Infection Kinetics of Genotype 1-7 EGFP-Reporter Viruses in Huh7.5 Cells.

Huh7.5 cells were infected at 0.01 MOI (multiplicity of infection) with viral stocks derived at time points with peak infection of Huh7.5 cultures transfected with RNA transcripts from the following constructs: pH77/JFH1(T2700C, A4080T)-EGFPΔ; pTN/JFH1(T2700C,A4080T)-EGFPΔ; pJ4/JFH1(T2996C,A4827T)-EGFPΔ; pJ6/JFH1-EGFPΔ; pJ8/JFH1-EGFPΔ; pS52/JFH1(T2718G,A4550C)-EGFPΔ, pS52/JFH1(A4550C)-EGFPΔ, indicated by (*); pED43/JFH1(A2819G,A3269T)-EGFPΔ; pSA13/JFH1(C3405G, A3696G)-EGFPΔ; pHK6a/JFH1(T1389C,A1590C)-EGFPΔ; pQC69/JFH1(T2985C,C9018T)-EGFPΔ; pJ6/JFH1.

Percentage of HCV infected cells was determined by (A) direct visualization of EGFP by fluorescence microscopy or (B) flow cytometry.

FIG. 9

Peak Infectivity Titers of Genotype 1-7 EGFP-Reporter Viruses.

Figure 8:
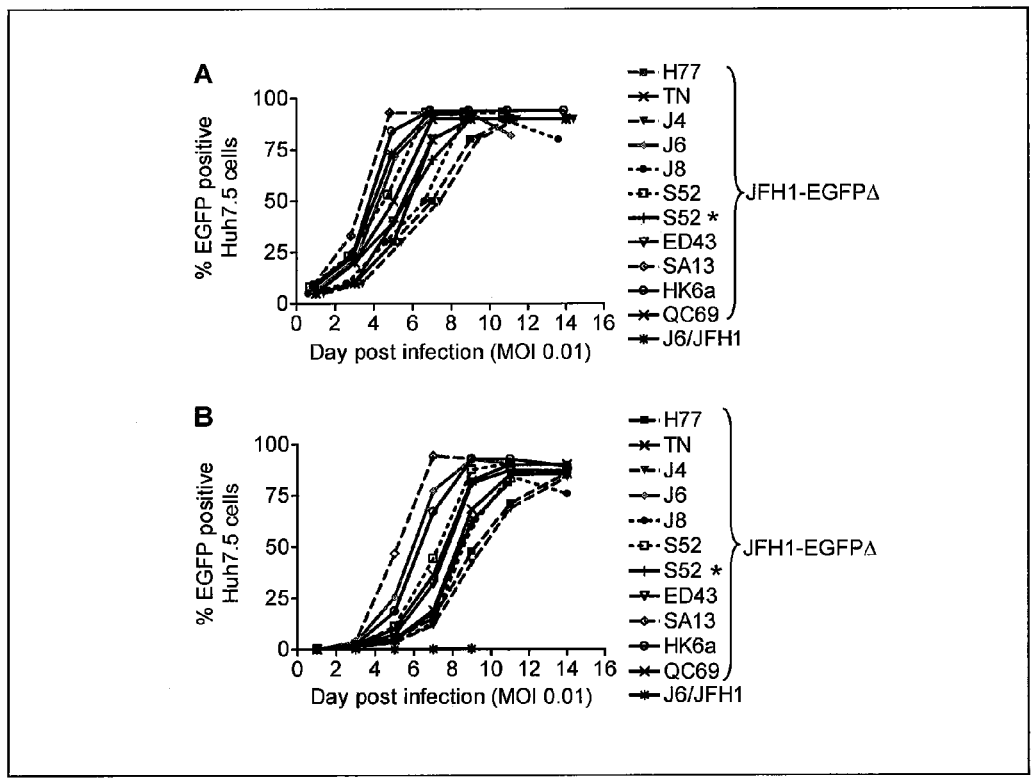

Infectivity titers of cell culture supernatants, derived from peak time points of the infection experiment shown in FIG. 8, were determined. Cell cultures were infected with the following viruses: H77/JFH1(T2700C,A4080T)-EGFPΔ; TN/JFH1(T2700C,A4080T)-EGFPΔ; J4/JFH1(T2996C,A4827T)-EGFPΔ; J6/JFH1-EGFPΔ; pJ8/JFH1-EGFPΔ; S52/JFH1(T2718G,A4550C)-EGFPΔ; ED43/JFH1(A2819G, A3269T)-EGFPΔ; SA13/JFH1(C3405G,A3696G)-EGFPΔ; HK6a/JFH1(T1389C,A1590C)-EGFPΔ; QC69/JFH1(T2985C,C9018T)-EGFPΔ; J6/JFH1.

FIG. 10

In Contrast to pJ6/JFH1-hRlucΔ, J6/JFH1-hRluc has Impaired Viability in Huh7.5 Cells.

(A, C) In two independent experiments, Huh7.5 cells were transfected with RNA transcripts of pJ6/JFH1-hRluc, pJ6/JFH1-hRluc (Δ indicates deletion of nt 7016-7135, leading to deletion of JFH1 NS5A aa 250-289), or J6/JFH1. (A,B,C,D) Percentages of HCV infected cells were determined by immuno staining for HCV NS5A followed by fluorescence microscopy. (*) At these timepoint, the percentage of infected cells was difficult to determine, because approximately 60% of cells showed bright staining, while 40% of cells showed weak staining. (B) Huh7.5 cells were infected with 1.8 ml supernatant derived at day 14 post transfection or 0.14 ml supernatant derived at day 4 post transfection from the J6/JFH1 culture shown in (A). (D) Huh7.5 cells were infected with 3 ml supernatant derived at day 14 post transfection from the J6/JFH1-hRluc culture shown in (C).

FIG. 11

J6/JFH1-hRlucΔ has Similar Growth Characteristics as J6/JFH1 in Huh7.5 Cells.

Huh7.5 cells were infected at 0.001 and 0.01 MOI with viral stocks derived at time points with peak infection of Huh7.5 cultures transfected with RNA transcripts from J6/JFH1-hRlucΔ or J6/JFH1. Cultures were followed by (A) determination of percentage of HCV infected cells by immuno staining for HCV NS5A followed by fluorescence microscopy; and (B) determination of infectivity titer, (*) value below cut-off (1.7 log 10 FFU/ml). (C) Luminescence activity of the *Renilla* luciferase reporter was measured as relative light units (RLU) in lysates of infected cells, (*) value below background detected for non-infected Huh7.5 cells (3 log 10 RLU).

FIG. 12

Transfection Kinetics of Genotype 1-7 hRluc-Reporter Viruses in Huh7.5 Cells.

Huh7.5 cells were transfected in parallel with RNA transcripts from pH77/JFH1(T2700C,A4080T)-hRlucΔ; pTN/JFH1(T2700C,A4080T)-hRlucΔ; pJ4/JFH1(T2996C, A4827T)-hRlucΔ; pJ6/JFH1-hRlucΔ; pJ8/JFH1-hRlucΔ; pS52/JFH1(T2718G,A4550C)-hRlucΔ; pED43/JFH1(A2819G,A3269T)-hRlucΔ; pSA13/JFH1(C3405G, A3696G)-hRlucΔ; pHK6a/JFH1(T1389C,A1590C)-hRlucΔ; pQC69/JFH1(T2985C,C9234T)-hRlucΔ; pJ6/JFH1. (A) Percentage of HCV infected cells was determined by immuno staining for HCV NS5A followed by fluorescence microscopy. (B) At time points, at which infection peaked, luminescence activity was determined in lysates of infected cells. Time points were day 7 post transfection for hRluc-reporter viruses with Core-NS2 of SA13; day 9 post infection for hRluc-reporter viruses with Core-NS2 of H77, TN, J4, S52, ED43 and HK6a; and day 12 post transfection for hRluc-reporter viruses with Core-NS2 of J6, J8 and QC69. For each culture one lysate was obtained and luminescence determined in a single measurement.

Cut-off was determined by luminescence of lysates from cells infected with J6/JFH1, not expressing a Luciferase reporter gene (4.4 log 10 RLU/ml).

FIG. 13

Infection Kinetics of Genotype 1-7 hRluc-Reporter Viruses in Huh7.5 Cells.

Figure 12:
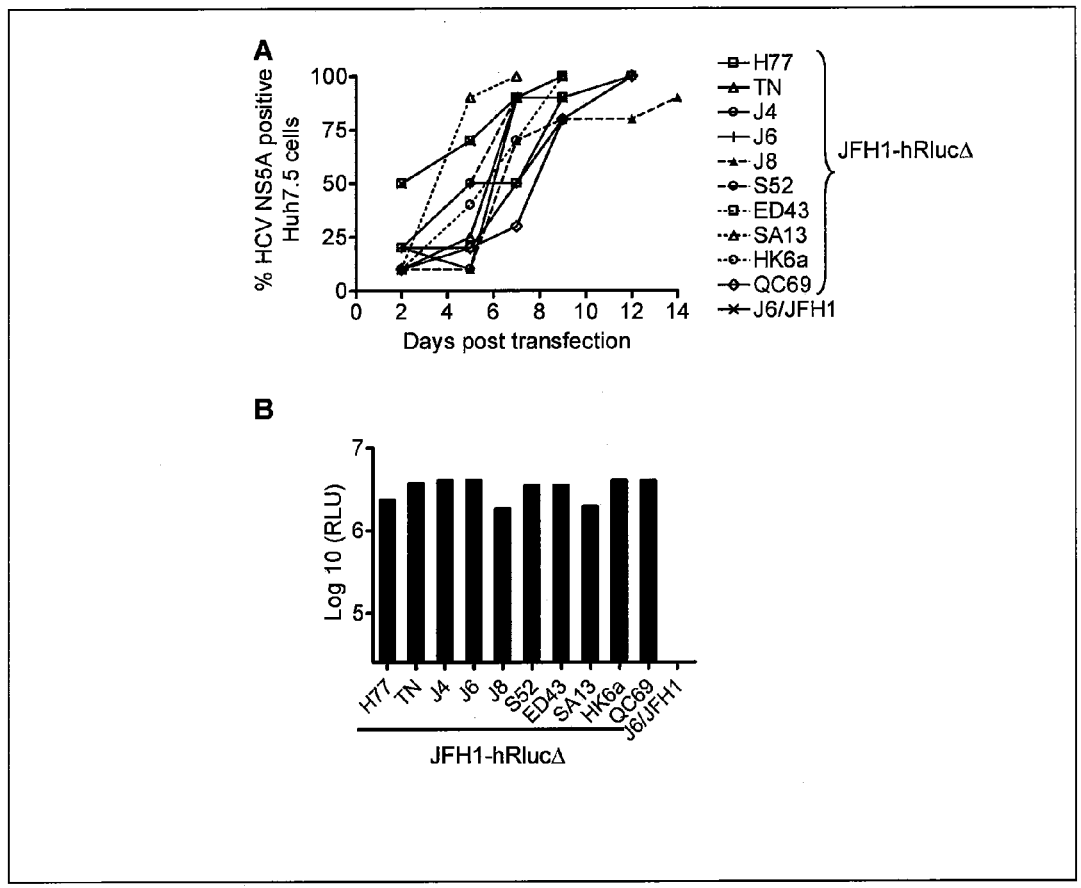

Huh7.5 cells were infected with 3 ml of cell culture supernatant derived at time points with peak infection from transfected cultures shown in FIG. 12. (A) Percentage of HCV infected cells was determined by immuno staining for HCV NS5A followed by fluorescence microscopy. (B) At time points, at which infection peaked, luminescence activity was determined in lysates of infected cells.

Time points were day 5 post infection for hRluc-reporter virus with Core-NS2 of SA13; day 7 post infection for hRluc-reporter viruses with Core-NS2 of J6, S52 and HK6a; day 12 post infection for hRluc-reporter virus with Core-NS2 of J8 and QC69; day 14 post infection for hRluc-reporter virus with Core-NS2 of TN, J4 and ED43; and day 28 post infection for hRluc-reporter virus with Core-NS2 of H77. For each culture one lysate was obtained and luminescence was determined in two measurement; values are means of the two measurements. Cut-off was determined by luminescence of lysates from cells infected with J6/JFH1, not expressing a Luciferase reporter gene (3.6 log 10 RLU/ml).

FIG. 14

J6/JFH1-CherryΔ and J6/JFH1-DSRedΔ Show Efficient Spread in Huh7.5 Cell Culture.

(A) Huh7.5 cells were transfected in parallel with RNA transcripts from pJ6/JFH1-CherryΔ (Δ indicates deletion of nt 7016-7135, leading to deletion of JFH1 NS5A aa 250-289), pJ6/JFH1-DSRedΔ (Δ indicates deletion of nt 7016-7135, leading to deletion of JFH1 NS5A aa 250-289), and pJ6/JFH1. Percentages of HCV infected cells were determined by immuno staining for HCV NS5A followed by fluorescence microscopy. (B) Huh7.5 cells were infected at 0.01 MOI with supernatant derived from the peak of infection from (A); for J6/JFH1-CherryΔ and J6/JFH1, supernatant derived at day 4 post transfection was used, and for J6/JFH1-DSRedΔ supernatant derived at day 7 post transfection was used. (C) Infectivity titers of supernatants obtained in the infection experiment shown in (B) are shown. (*) Value below cut-off (1.7 log 10 FFU/ml).

FIG. 15

JFH1-Based Recombinants with Genotype-Specific Core-NS2 with Either (i) Homotypic 5'UTR, (ii) Heterotypic Genotype 1a 5'UTR or (iii) Heterotypic Genotype 3a 5'UTR Spread Efficiently in Huh7.5 Cells after Transfection.

Previously developed JFH1-based intergenotypic recombinant cell culture systems with Core-NS2 of genotype 1-7 all contain JFH1 5'UTR. In the present study we (i) replaced the JFH1 5'UTR of Core-NS2 recombinants of genotype 1-6 with genotype specific homotypic 5'UTR. For Core-NS2 recombinants of genotype 1-7, we replaced the JFH1 5'UTR (ii) with heterotypic genotype 1a (H77) 5'UTR, and (iii) with heterotypic genotype 3a (S52) 5'UTR. The in vitro transcribed RNA transcripts were transfected into naïve Huh7.5 cells, the percentages of HCV positive cells were detected by immunostaining for HCV NS5A. Original recombinants with JFH1 5'UTR and replication defective recombinant J6/JFH-GND were used in parallel as positive and negative controls, respectively. The spread kinetics of the JFH1-based intergenotypic Core-NS2 recombinants with various 5'UTR in Huh7.5 cells after transfection are shown.

FIG. 16

JFH1-Based Recombinants with Core-NS2 of Genotype 2a or 3a with 5'UTR of Genotypes 1a, 2a, and 3a are Comparable in Virus-Spread Kinetics.

Naïve Huh7.5 cells were inoculated at 0.003 MOI with supernatant from transfection cultures of JFH1-based recombinants with Core-NS2 of genotype 2a and 3a containing (i) the genotype-specific homotypic 5'UTR or (ii) heterotypic 5'UTRs (genotype 1a (H77), 2a (JFH1) and 3a (S52) 5'UTR for 2a Core-NS2 recombinant; genotype 1a (H77) and 2a (JFH1) 5'UTR for 3a Core-NS2 recombinant). Percentage of HCV infected cells was detected by immunostaining for HCV NS5A. J6/JFH-GND was used as a negative control.

FIG. 17

RNA and Infectivity Titers of JFH1-Based Recombinants with Core-NS2 of Genotypes 2a and 3a with 5'UTR of Genotypes 1a, 2a, and 3a.

Figure 16:
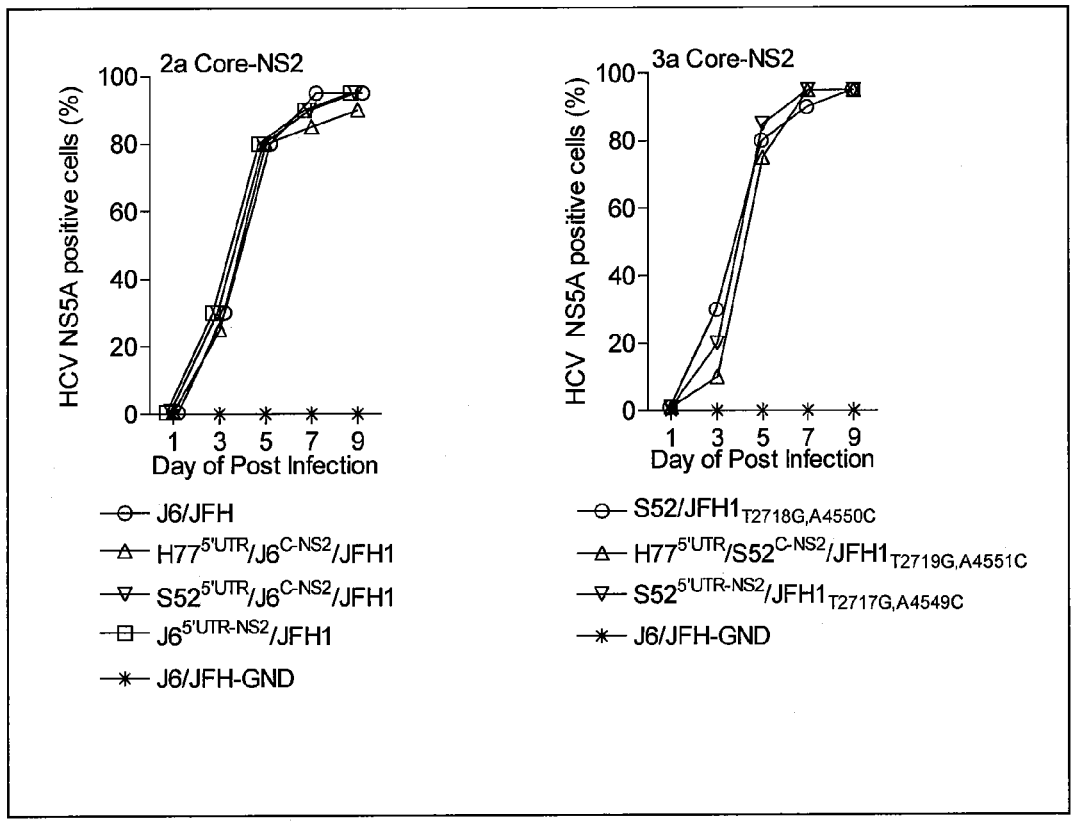

For the kinetic study shown in FIG. 16, supernatants were collected throughout the experiment. Infectivity titers and RNA titers of supernatants were determined as described in Material and Methods.

FIG. 18

JFH1-Based Recombinants with Core-NS2 of Genotypes 1a, 1b, 2b, 4a, 5a and 6a with Genotype-Specific Homotypic 5'UTR are Comparable to the Respective Recombinants with JFH1 5'UTR with Respect to Virus-Spread Kinetics, RNA Titers and Infectivity Titers.

Naïve Huh7.5 cells were inoculated at 0.003 MOI with supernatants derived from transfection cultures of JFH1-based intergenotypic recombinants containing (i) genotype-specific homotypic 5'UTR and (ii) JFH1 5'UTR. Percentage of HCV infected cells was detected by immunostaining for HCV NS5A. RNA titers and infectivity titers of selected time points at the peak of infection were determined as described in Material and Methods.

FIG. 19.

Analysis of Genetic Stability of JFH1-Based Recombinants with Core-NS2 of Genotype 1-6 with Genotype-Specific Homotypic 5'UTRs and Heterotypic Genotype 1a and 3a 5'UTRs.

Transfection supernatant was used for a first passage experiment in naïve Huh7.5 cells (table indicates day post transfection (p.t.), at which supernatant was collected and used for infection of first passage experiment; % infected cells at the respective time point; MOI used for infection of first passage; ND, MOI was not determined, 1 ml of transfection supernatant was used for infection). First passage supernatant was collected at peak of infection for sequence analysis of whole genomes including UTRs (day post infection (p.i.), at which supernatant was collected, and % infected cells at the respective timepoint is indicated). 5'UTR sequences were determined by 5'RACE on the positive strand HCV RNA from supernatant; 3'UTR sequences were determined by 5'RACE on the negative strand HCV RNA from cells.

§The first nucleotide G of 1a, 1b, 2b, 3a and 6a 5'UTR was changed to A, while the first nucleotide A of 2a, 4a and 5a 5'UTR was preserved. In one of two experiments for 2a, 2b, 6a Core-NS2 recombinants containing the genotype-specific 5'UTR, mutations were found in the Core-3'UTR region. Mutation position corresponds to respective genome, the resulting amino acid changes are shown in parenthesis if coding. The first capital letter indicates the nucleotide found at the indicated position in the plasmid used for the original transfection. The letters following the indicated position indicate the nucleotides found in viral genomes in $1^{st}$ passage.

Two capital letters separated by a slash indicate the presence of a 50/50 quasispecies, whereas a capital letter separated by a slash from a lowercase letter indicates a quasispecies with a predominant vs a minor sequence. #NS2, C3015C/T(1892I/T), T3149T/C(Y937Y/H); NS3, T3613T/C. ºNS2, C3397C/T(A1019A/V); NS3, A3690A/T(S1117S/C), T5207T/A. ℰ(E2, A1570A/G(N410N/D), G2542G/T(D734D/Y); NS2, T3017T/C(F892S); NS5A, A6424a/G(T2028T/A), G6865g/A(A2175A/N), T7024T/C(Y2228Y/H).

FIG. 20

J6/JFH1 Recombinants with 5'UTR of Genotype 1-6 Efficiently Spread in Huh7.5 Cells and have Similar Infectivity Titers.

RNA transcripts were transfected into naïve Huh7.5 cells, the percentages of HCV positive cells were determined by immunostaining for HCV NS5A at indicated time points. The infectivity titer at day 3 post transfection was determined. J6/JFH and replication defective recombinant J6/JFH-GND was used in parallel as positive and negative control, respectively.

FIG. 21

J6/JFH1 Recombinants with 5'UTR of Genotype 1-6 are Comparable to Each Other with Respect to Virus-Spread Kinetics as Well as RNA and Infectivity Titers.

Naïve Huh7.5 cells were inoculated at 0.003 MOI with supernatant of transfection cultures of J6/JFH1 recombinants containing the 5'UTR of genotype 1-6. Percentages of HCV infected cells were determined by immunostaining for HCV NS5A. RNA titers and infectivity titers were determined as described in Materials and Methods The present invention will now be described in more detail in the following.

DETAILED DESCRIPTION OF THE INVENTION

Definitions

Prior to discussing the present invention in further details, the following terms and conventions will first be defined:

In the present context the term "genotype" is to be understood in accordance with Simmonds et al. 2005—i.e. the term "genotype" relate to the presently 7 identified major HCV genotypes. The terms "genotype" and "major genotype" are used herein interchangeably.

In the present context the term "subtype" is to be understood in accordance with Simmonds et al. 2005—in relation to genotype 1, this means the presently identified subtypes indicated by lower-case letters; 1a, 1b, 1c etc. (Simmonds et al. 2005).

In the present context the term "isolate" is to be understood in accordance with Simmonds et al. 2005—in relation to subtype 1a this means for example H77C and TN whereas it in relations to 1b means for example J4. Several different isolates/strains exist within the same subtype. The terms "isolate" and "strain" are used herein interchangeably.

As commonly defined "identity" is here defined as sequence identity between genes or proteins at the nucleotide or amino acid level, respectively.

Thus, in the present context "sequence identity" is a measure of identity between proteins at the amino acid level and a measure of identity between nucleic acids at nucleotide level. The protein sequence identity may be determined by comparing the amino acid sequence in a given position in each sequence when the sequences are aligned. Similarly, the nucleic acid sequence identity may be determined by comparing the nucleotide sequence in a given position in each sequence when the sequences are aligned.

To determine the percent identity of two amino acid sequences or of two nucleic acids, the sequences are aligned for optimal comparison purposes (e.g., gaps may be introduced in the sequence of a first amino acid or nucleic acid sequence for optimal alignment with a second amino or nucleic acid sequence). The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position. The percent identity between the two sequences is a function of the number of identical positions shared by the sequences (i.e., % identity=# of identical positions/total # of positions (e.g., overlapping positions)×100). In one embodiment the two sequences are the same length.

One may manually align the sequences and count the number of identical amino acids. Alternatively, alignment of two sequences for the determination of percent identity may be accomplished using a mathematical algorithm. Such an algorithm is incorporated into the NBLAST and XBLAST programs of. BLAST nucleotide searches may be performed with the NBLAST program, score=100, wordlength=12, to obtain nucleotide sequences homologous to a nucleic acid molecules of the invention. BLAST protein searches may be performed with the XBLAST program, score=50, wordlength=3 to obtain amino acid sequences homologous to a protein molecule of the invention. To obtain gapped alignments for comparison purposes, Gapped BLAST may be utilised. Alternatively, PSI-Blast may be used to perform an iterated search, which detects distant relationships between molecules. When utilising the NBLAST, XBLAST, and Gapped BLAST programs, the default parameters of the respective programs may be used. See http://www.ncbi.nlm.nih.gov. Alternatively, sequence identity may be calculated after the sequences have been aligned e.g. by the BLAST program in the EMBL database (www.ncbi.nlm.gov/cgi-bin/BLAST). Generally, the default settings with respect to e.g. "scoring matrix" and "gap penalty" may be used for alignment. In the context of the present invention, the BLASTN and PSI BLAST default settings may be advantageous.

The percent identity between two sequences may be determined using techniques similar to those described above, with or without allowing gaps. In calculating percent identity, only exact matches are counted.

To determine the efficiency of the developed system, HCV RNA titers are determined in IU/ml (international units/ml) with Taq-Man Real-Time-PCR and infectious titers are determined with a focus-forming units (FFU) method: in this method, infectivity titers are determined by infection of cell culture replicates with serial dilutions of virus containing supernatants and, following immuno-stainings for HCV antigens, counting of HCV-antigen positive cell foci. Alternatively the infectious titers are determined as 50% tissue culture infectious dose. This titer shows the dilution of the examined viral stock, at which 50% of the replicate cell cultures used in the essay become infected and is given in $TCID_{50}/ml$.

In the present context the term "absolute nucleotide/amino acid number" is to understood as the nucleotide position on the entire HCV genome, counting from nucleotide 1 of the entire HCV genome and thus from nucleotide 1 of the 5'UTR, or as the amino acid position on the entire HCV polyprotein, counting from amino acid 1 of the entire HCV polyprotein and thus from amino acid 1 of HCV Core protein.

In the present context the term "relative nucleotide/amino acid number" is to be understood as the nucleotide position on the respective HCV gene, counting from nucleotide 1 of the respective HCV gene, e.g. from nucleotide 1 of HCV NS5A protein, or as the amino acid position on the respective HCV gene, counting from amino acid 1 of the respective HCV gene, e.g. from amino acid 1 of HCV NS5A protein.

The terms "ΔEGFP" and "EGFPΔ" are used in here interchangeably—different subscript of the terms are also used herein interchangeably.

The terms "ΔhRluc" and "hRlucΔ" are used in here interchangeably—different subscript of the terms are also used herein interchangeably.

The terms "ΔCherry" and "CherryΔ" are used inhere interchangeably—different subscript of the terms are also used herein interchangeably.

The terms "ΔDSRed" and "DSRedΔ" are used inhere interchangeably—different subscript of the terms are also used herein interchangeably.

The terms "J6/JFH1" and "J6/JFH" are used herein interchangeably.

Nucleic Acid and Amino Acid Molecules

Even though many strategies have been tried, so far no efficient panel of reporter viruses of recombinants of all HCV genotypes has been provided. In bicistronic reporter viruses, replication seemed to be impaired; also monocistronic viruses with reporter genes inserted in NS5A, have so far shown significantly impaired viability. Also, it has not been shown that the developed systems were genetically stable, and other investigators have not demonstrated that the inserted reporter gene was maintained in the virus during replication. The present invention now provides a panel of monocistronic JFH1-based recombinants of all major HCV genotypes with a reporter gene inserted in HCV NS5A, whose efficient growth characteristics depend on a deletion in NS5A.

In a broad aspect, the present invention is directed to a genetically engineered hepatitis C virus (HCV) encoded by nucleic acid sequences such as a complementary DNA (cDNA) sequence and replicating RNA comprising the non-structural gene NS5A wherein a reporter gene is inserted in domain III of the non-structural gene NS5A and further comprising a deletion in the non-structural gene NS5A.

It is to be understood that any HCV capable of replicating is an aspect of the present invention. This includes any HCV comprising adaptive mutations—this, includes adaptive mutation previously disclosed (examples are shown in Table 2) and adaptive mutations acquired during subsequent passages.

The replicating HCV RNA comprises the structural genes (Core, E1, E2), p7 and NS2 of genotype 1a, 1b, 2a, 2b, 3a, 3b, 4a, 4b, 5a, 6a, 6b or 7a and the non-structural genes NS3, NS4A, NS4B, NS5A and NS5B of JFH1 as well as a reporter gene inserted in domain III of the non-structural gene NS5A, which further has a deletion in the non-structural gene NS5A.

The replicating HCV RNA comprises the structural genes (Core, E1, E2), p7 and NS2 of genotype 1a, 1b, 2a, 2b, 3a, 3b, 4a, 4b, 5a, 6a, 6b or 7a and the non-structural genes NS3, NS4A, NS4B, NS5A and NS5B and untranslated regions of JFH1, as well as a reporter gene inserted in domain III of the non-structural gene NS5A, which further has a deletion in the non-structural gene NS5A.

Various other viruses with viability in cell culture could be tagged similarly by insertion of a reporter gene in domain III of NS5A together with a deletion in the non-structural gene NS5A.

In an embodiment other isolates of the same genotype may be used in JFH1-based intra- and intergenotypic recombinants. In an embodiment isolate TN or DH6 may replace isolate H77 of genotype 1a. In an embodiment isolate DH1 or DH5 may replace isolate J4 of genotype 1b. In an embodiment isolate DBN or DH11 may replace isolate S52 of genotype 3a. In a further embodiment isolates of subtypes 1c, 1d, etc. may be used instead of isolates of subtypes 1a and 1b, similarly for major genotypes 2, 3, 4 and 6.

Further, various JFH1-based recombinants with different intra- and intergenotypic junctions may be constructed. The present inventors constructed ED43/JFH1-beta, in which the intergenotypic junction is located within NS2. It would be of great interest to generate viruses, in which JFH1-sequences are replaced by genotype specific sequences. Thus, the present inventors have shown that the genotype specific 5' UTR can be inserted in the JFH1-based recombinants developed. The present inventors have also obtained evidence, that certain non-structural genes of various genotypes can be inserted in J6/JFH1.

Further, other HCV isolates except JFH1 might be identified, which can grow in cell culture. If such isolates were identified, it would be of interest to construct cDNA clones of those with reporter genes and the described deletion inserted in NS5A.

The present inventors have detected two different deletions in J6/JFH1 viruses tagged with EGFP. One at nucleotide position 748-867 corresponding to amino acid position 250 to 289 of the non-structural gene NS5A and another one at nucleotide position 797-871 corresponding to amino acid position 266 to 290 of the non-structural gene NS5A (positions are given with relative nt/aa numbers). Deletion at amino acid position 250 to 289 of the non-structural gene NS5A has been tested in reverse genetic studies in J6/JFH1 and JFH1-based recombinants with reporter genes; this deletion was shown to enable insertion of different reporter genes in NS5A of JFH1-based recombinants with Core-NS2 of different HCV genotypes. The deletion at amino acid position 266 to 290 has been tested in reverse genetic studies in J6/JFH1. The mechanism by which this deletion confers favourable growth kinetics to JFH1-based recombinants with reporter genes in domain III of NS5A is unclear. Possibly, introduction of a reporter gene results in an unfavourable conformation of NS5A and the deletion compensates for this steric hinderance.

Thus, in one embodiment, the present invention relates to replicating RNA comprising the structural genes (Core, E1, E2), p7, and the non-structural gene NS2 or at least part of the non-structural gene NS2 of genotype 1a, 1b, 2a, 2b, 3a, 4a, 5a, 6a, or 7a and the non-structural genes NS3, NS4A, NS4B, NS5A and NS5B from the JFH1 strain and wherein a reporter gene is inserted in domain III of the non-structural gene NS5A and further comprising a deletion in the non-structural gene NS5A.

Thus, in one embodiment, the present invention relates to replicating RNA comprising the structural genes (Core, E1, E2), p7, and the non-structural gene NS2 or at least part of the non-structural gene NS2 of genotype 1a, 1b, 2a, 2b, 3a, 4a, 5a, 6a, or 7a and the non-structural genes NS3, NS4A, NS4B, NS5A and NS5B, as well as the untranslated regions, from the JFH1 strain and wherein a reporter gene is inserted in domain III of the non-structural gene NS5A and further comprising a deletion in the non-structural gene NS5A.

In an embodiment of the present invention the untranslated regions is the 5'UTR.

In an embodiment of the present invention the untranslated regions is the 3'UTR.

It is to be understood that other genotypes and subtypes are applicable to the present invention such as but not limited to 3b, 4b and 6b.

In another embodiment, the deletion in the non-structural gene NS5A is located upstream of the inserted reporter gene in the replicating RNA.

In another embodiment, the deletion in the non-structural gene NS5A is located between amino acid position 1 and 418 of the non-structural gene NS5A.

In yet another embodiment, the deletion in the non-structural gene NS5A is located at amino acid position 250 to 289 of the non-structural gene NS5A.

In yet another embodiment, the deletion in the non-structural gene NS5A is located at amino acid position 266 to 290 of the non-structural gene NS5A.

In a further embodiment, the deletion in the non-structural gene NS5A is located between nucleotide position 1 and 1254.

In a further embodiment the deletion in the non-structural gene NS5A is located between nucleotide position 748 and 867.

In yet an embodiment the deletion in the non-structural gene NS5A is located between nucleotide position 797 and 871.

A J6/JFH1-EGFP reporter virus was constructed by in frame insertion of the EGFP coding sequence in domain III of NS5A of the J6/JFH reference recombinant.

In two independent transfections of Huh7.5 cells with RNA transcripts, J6/JFH1-EGFP viruses spread to >50% of the cells after an eclipse phase of 13 and 19 days, respectively, compared to J6/JFH virus, which spread immediately (FIGS. 1A and B). At day 15 of the 1st transfection experiment (FIG. 1A), J6/JFH1-EGFP yielded an infectivity titer of 1E4.3 FFU/ml compared to 1E4.1 FFU/ml for J6/JFH. On day 19 of the 2nd transfection experiment, J6/JFH1-EGFP yielded 1E3.8 FFU/ml.

In 1st and 2nd passage experiments of virus from one transfection experiment (FIG. 1A), J6/JFH1-EGFP showed spread kinetics and HCV RNA titers comparable to J6/JFH (example of 1st passage experiment shown in FIG. 1C). Also infectivity titers were comparable at 1E3.2 FFU/ml for J6/JFH1-EGFP and 1E3.3 FFU/ml for J6/JFH (day 10 of 1st passage shown in FIG. 1C).

Direct sequencing of the complete open reading frame (ORF) of viral genomes from 1st transfection (FIG. 1A, day 15) and consecutive passage culture supernatant (FIG. 1C, day 8 and data not shown) revealed deletion of nt 7016-7135 (absolute nucleotide number relating to the complete J6/JFH1 genome) in NS5A, upstream of the introduced EGFP sequence, leading to deletion of nt 748-867 and thus aa 250-289 of JFH1 NS5A (relative nt/aa number relating to JFH1 NS5A)

In the 2nd transfection experiment (FIG. 1B, day 19) nt 7065-7139 (absolute nucleotide number relating to the complete J6/JFH1 genome) were deleted, leading to deletion of nt 797-871 and thus aa 266-290 of JFH1 NS5A (relative nt/aa number relating to JFH1 NS5A). Sequence analysis from the two transfections and several passage experiments derived from the 1st transfection indicated, that J6/JFH1-EGFP did not require additional adaptive mutations.

A selected deletion of nt 7016-7135 (leading to deletion of JFH1 NS5A aa 250-289) was analysed in reverse genetic studies. After transfection of RNA transcripts from J6/JFH1-EGFPΔ (SEQ ID NO: 3), viral spread was as efficient as for J6/JFH1 in transfection and 1st passage experiments (FIGS. 2 A and B). On day 8 of the 1st passage (FIG. 2B), infectivity titers were 1E4.3 FFU/ml and sequence analysis showed, that J6/JFH1-EGFPΔ was genetically stable, thus confirming, that deletion of nt 7016-7135 (leading to deletion of JFH1 NS5A aa 250-289) was sufficient to confer cell culture adaptation.

In order to develop a panel of EGFP-reporter viruses of the major HCV genotypes, JFH1-based intergenotypic recombinants containing Core through NS2 sequences of prototype isolates of genotypes 1a (strains H77 and TN), 1b (J4), 2b (J8), 3a (S52), 4a (ED43), 5a (SA13), 6a (HK6a) and 7a (QC69) is used.

For development of EGFP-tagged reporter constructs, previously developed JFH1-based intergenotypic recombinants with optimal combinations of cell culture adaptive mutations were chosen (Gottwein et al. 2009). It should be noted that for some of these recombinants (e.g. S52/JFH1), several combinations of mutations were shown to be efficient, and in theory several different EGFP-tagged reporter viruses could be constructed, using differently adapted genomes. Examples of such adaptive mutations are shown in Table 2.

Thus, in another embodiment, the JFH1-based Core-NS2 recombinants of genotype 1a, 1b, 3a, 4a, 5a, 6a and 7a used as backbone for the NS5A construct harbour different adaptive mutations than the ones given in the text below.

Additional cell culture experiments were done. In a first set of experiments, the following viruses were tested: H77/JFH1-EGFPΔ (with H77/JFH1 cell culture adaptive mutations T2700C,A4080T encoding amino acid changes V787A, Q1247L) (SEQ ID NOs: 69 and 89), S52/JFH1-EGFPΔ (with S52/JFH1 cell culture adaptive mutation A4550C encoding amino acid change K1404Q) (SEQ ID NOs: 73 and 93), ED43/JFH1-EGFPΔ (with ED43/JFH1 cell culture adaptive mutations A2819G,A3269T encoding amino acid changes T827A,T977S) (SEQ ID NOs: 74 and 94), SA13/JFH1-EGFPΔ (with SA13/JFH1 cell culture adaptive mutations A2819G,A3269T encoding amino acid changes A1022G, K1119R) (SEQ ID 75 and 95) and HK6a/JFH1-EGFPΔ (with HK6a/JFH1 cell culture adaptive mutations T1389C,A1590C encoding amino acid changes F350S,N417T) (SEQ ID 76 and 96). RNA transcripts of the respective cDNA clones were transfected in Huh7.5 cells. The viruses spread to the complete cell culture in 6-10 days post transfection (FIG. 3A). In an independent transfection experiment, S52/JFH1-EGFPΔ (with S52/JFH1 cell culture adaptive mutation A4550C encoding amino acid change K1404Q) spread to >50% of the culture on day 67 and infected almost the complete cell culture on day 69 (data not shown). This delay in viral spread was not observed in consecutive experiments and might have been due to a technical problem.

In a consecutive $1^{st}$ passage experiment, all reporter viruses spread to the complete cell culture in 6-10 days, with the exception of H77/JFH1-EGFPΔ (with H77/JFH1 cell culture adaptive mutations T2700C,A4080T encoding amino acid changes V787A,Q1247L) infecting the majority of cells on day 17 (FIG. 3B). It seems likely, that this delay might be due to differences in the infectious dose used for inoculation. Infectivity titers at the peak of infection in this first set of experiments are given in Table 1.

Figure 9:
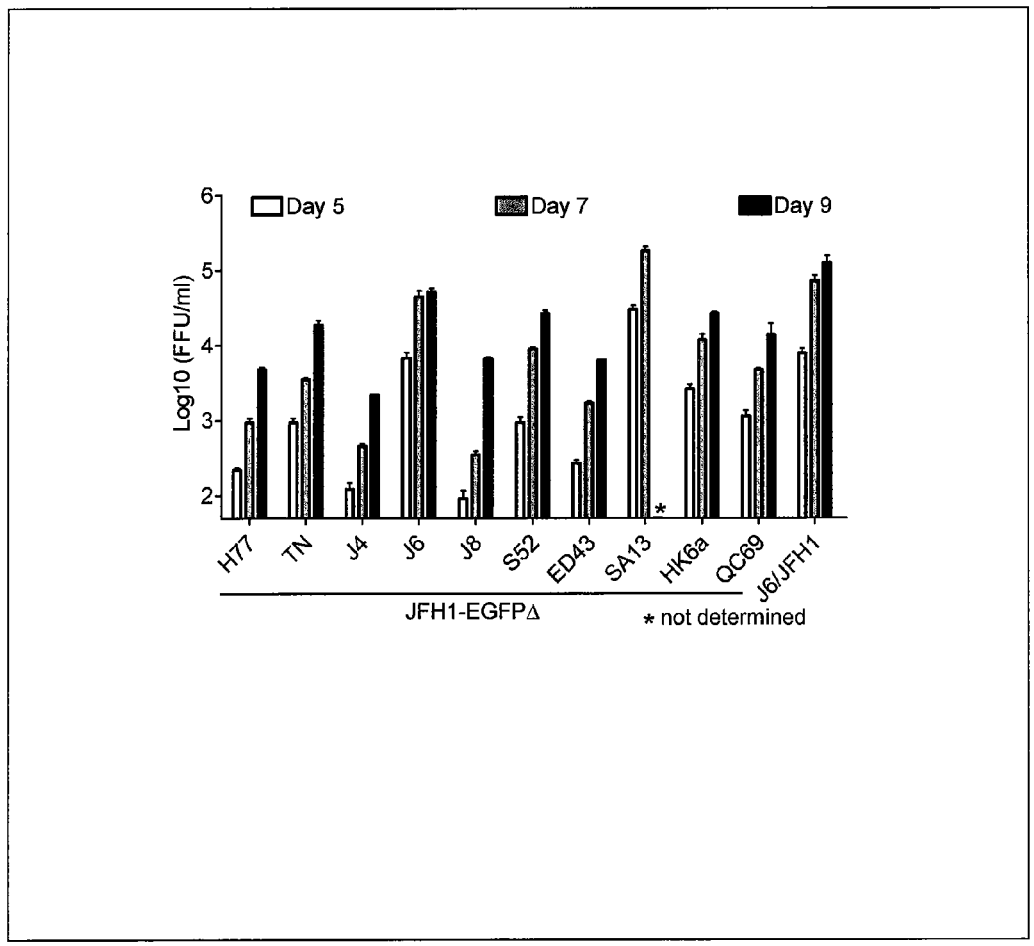

The present inventors completed the panel of EGFP reporter viruses to include recombinants with Core-NS2 of all major HCV genotypes and important subtypes. In a second set of experiments, we transfected Huh7.5 cells with RNA transcripts from the following EGFP reporter plasmids: pH77/JFH1(T2700C,A4080T)-EGFPΔ (SEQ ID NO: 69, encoded amino acid has SEQ ID NO: 89); pTN/JFH1 (T2700C,A4080T)-EGFPΔ (SEQ ID NO: 70, encoded amino acid has SEQ ID NO: 90); pJ4/JFH1(T2996C,A4827T)-EGFPΔ (SEQ ID NO: 71 encoded amino acid has SEQ ID NO: 91); pJ6/JFH1-EGFPΔ (SEQ ID NO: 13, encoded amino acid has SEQ ID NO: 3); pJ8/JFH1-EGFPΔ (SEQ ID NO: 4, encoded amino acid has SEQ ID NO: 14); pS52/JFH1 (T2718G,A4550C)-EGFPΔ (SEQ ID NO: 72, encoded amino acid has SEQ ID NO: 92); pS52/JFH1(A4550C)-EGFPΔ (SEQ ID NO: 73, encoded amino acid has SEQ ID NO: 93); pED43/JFH1(A2819G,A3269T)-EGFPΔ (SEQ ID NO: 74, encoded amino acid has SEQ ID NO: 94); pSA13/JFH1 (C3405G,A3696G)-EGFPΔ (SEQ ID NO: 75, encoded amino acid has SEQ ID NO: 95); pHK6a/JFH1(T1389C, A1590C)-EGFPΔ (SEQ ID NO: 76, encoded amino acid has SEQ ID NO: 96); pQC69/JFH1(T2985C,C9018T)-EGFPΔ (SEQ ID NO: 77, encoded amino acid has SEQ ID NO: 97). A positive control cell culture was transfected with RNA transcripts from pJ6/JFH1. After transfection, EGFP reporter viruses of all genotypes spread as fast as the positive control virus J6/JFH1 and infected the complete culture on day 3-6 after transfection (data not shown). Peak infectivity titers of transfection cultures were between 4.0-5.5 log 10 FFU/ml. We used virus-containing supernatants from transfection cultures at the peak of infection to infect naïve Huh7.5 cells with the same infectious dose of each virus (FIG. 8). In these first passage cultures, all viruses spread to the complete cell culture in 5-11 days. EGFP reporter activity was easily detectable with fluorescent microscopy (FIG. 8A) and flow cytometry (FIG. 8B). Infectivity titers at time points, at which infection peaked in this first passage, were between 4.0-5.5 log 10 FFU/ml (FIG. 9), thus being comparable to the infectivity titers observed for the respective non-tagged recombinants. At peak of infection of this first passage, genomes derived from cell culture supernatant were sequenced for all EGFP-reporter virus cultures. In direct sequence analysis of the complete open reading frame, we did not detect any nucleotide changes compared to the plasmids used for generation of RNA transcripts. Thus, the developed constructs were all genetically stable in cell culture. The engineered sequence encoded fully functional viral genomes giving rise to viruses that did not need further cell culture adaptation.

In order to enable high throughput luminescence-based assays, we aimed also at constructing luciferase-tagged reporter viruses. *Renilla* luciferase was inserted immediately downstream of codon 418 in J6/JFH1 NS5A with and without the identified deletion (nt 7016-7135, leading to deletion of JFH1 NS5A aa 250-289).

Subsequently several cell culture experiments were done to characterize the luciferase-tagged reporter viruses.

In a first experiment, after transfection of Huh7.5 cells, J6/JFH1-hRluc spread to the complete cell culture on day 28 (FIG. 4A). When transfection supernatant was passed to naïve Huh7.5 cells, this virus spread to the complete culture on day (FIG. 4B). In the same experiment, a transfection with RNA transcripts from pJ6/JFH1-hRlucΔ (SEQ ID NO: 10, encoded amino acid has SEQ ID NO: 20), with deletion of nt 7016-7135 (leading to deletion of JFH1 NS5A aa 250-289) as identified in culture experiments of J6/JFH1-EGFP, was carried out. Viral spread in this culture was delayed.

Figure 10:
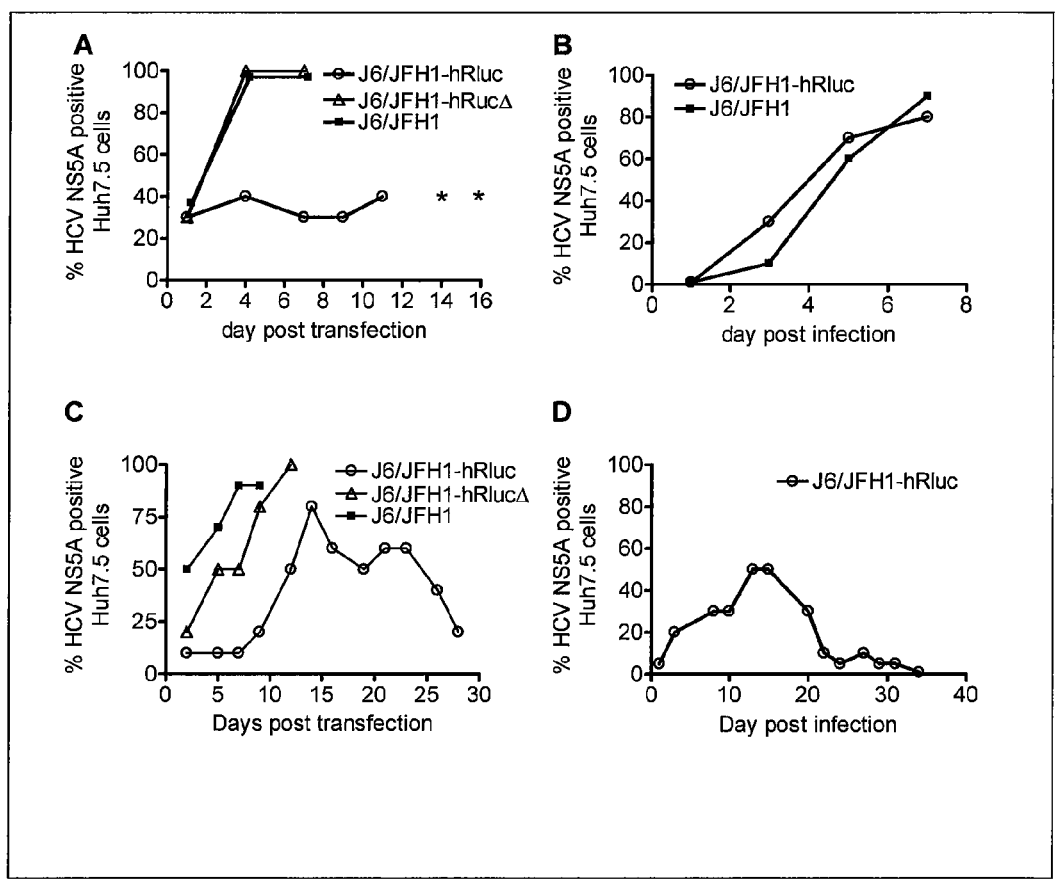

This experiment was repeated twice (FIG. 10). In FIG. 10 A and FIG. 10 C, transfection with RNA transcripts from constructs pJ6/JFH1-hRlucΔ (SEQ ID NO: 10, encoded amino acid has SEQ ID NO: 20), J6/JFH1-hRluc and pJ6/JFH1 is shown. In both experiments, viral spread of J6/JFH1-hRlucΔ was comparable to that of J6/JFH1. In contrast, viral spread of J6/JFH1-hRluc was impaired. During long term culture, spread to most cells of the culture was observed, however, in the same culture cells with high expression of HCV NS5A and low expression of HCV NS5A were observed (FIG. 10 A), indicating that 2 virus populations might be present; one virus population that was adapted to cell culture and led to high expression of NS5A in the infected cells, and another virus population that was not well adapted and expressed low levels of NS5A. When viral supernatant from transfection cultures was passaged to naïve cells (FIG. 10 B, D), different courses of infection were observed. Once (FIG. 10 B), J6/JFH1-hRluc spread rapidly; however, sequence analysis of viral genomes revealed, that this virus had deleted the hRluc reporter gene from its genome. In another 1$^{st}$ passage experiment (FIG. 10 D), J6/JFH1-hRluc spread inefficiently. In conclusion, the data shown in FIG. 10 indicate, that the identified 40 amino acid deletion (amino acid 250-289 of NS5A) led to viability of J6/JFH1 with hRluc reporter gene inserted in NS5A. In contrast, J6/JFH1 with hRluc reporter gene without the identified deletion showed strongly impaired viability, which first was improved after the virus had eliminated the hRluc gene.

Figure 11:
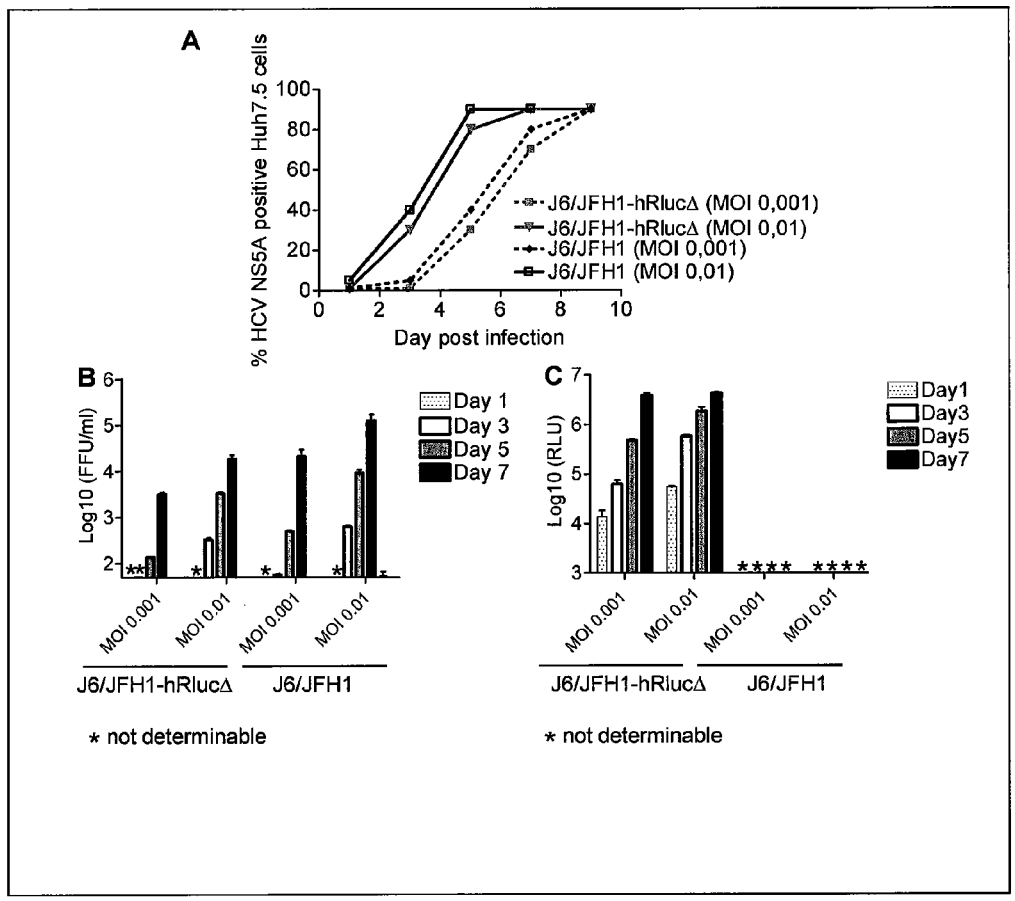

The present inventors did comparative kinetic studies with pJ6/JFH1-hRlucΔ (SEQ ID NO: 10, encoded amino acid has SEQ ID NO: 20) and pJ6/JFH1 (FIG. 11). After infection of Huh7.5 cells with the same dose of each virus, J6/JFH1-hRlucΔ and J6/JFH1 showed comparable spread kinetics, infecting the complete cell culture in 5-7 or in 9 days, depending on the infectious dose used (FIG. 11A). Peak infectivity titers of supernatants from cultures completely infected with J6/JFH1-hRluc were 4-4.5 logs FFU/ml, comparable to infectivity titers found for J6/JFH1 (FIG. 11B). Finally, we detected luminescence activity of the hRluc reporter with a luminescence plate reader. Luminescence increased during the course of infection and was, at the peak of infection, 3.5 logs RLU higher than luminescence of naïve cells (FIG. 11 C). Direct sequence analysis of viral genomes derived from peak of infection of this 1$^{st}$ passage experiment showed that J6/JFH1-hRlucΔ was genetically stable and did not require additional adaptive mutations. Thus, the identified deletion (nt 7016-7135, leading to deletion of JFH1 NS5A aa 250-289) allowed insertion of hRluc in NS5A of J6/JFH1.

Figure 13:
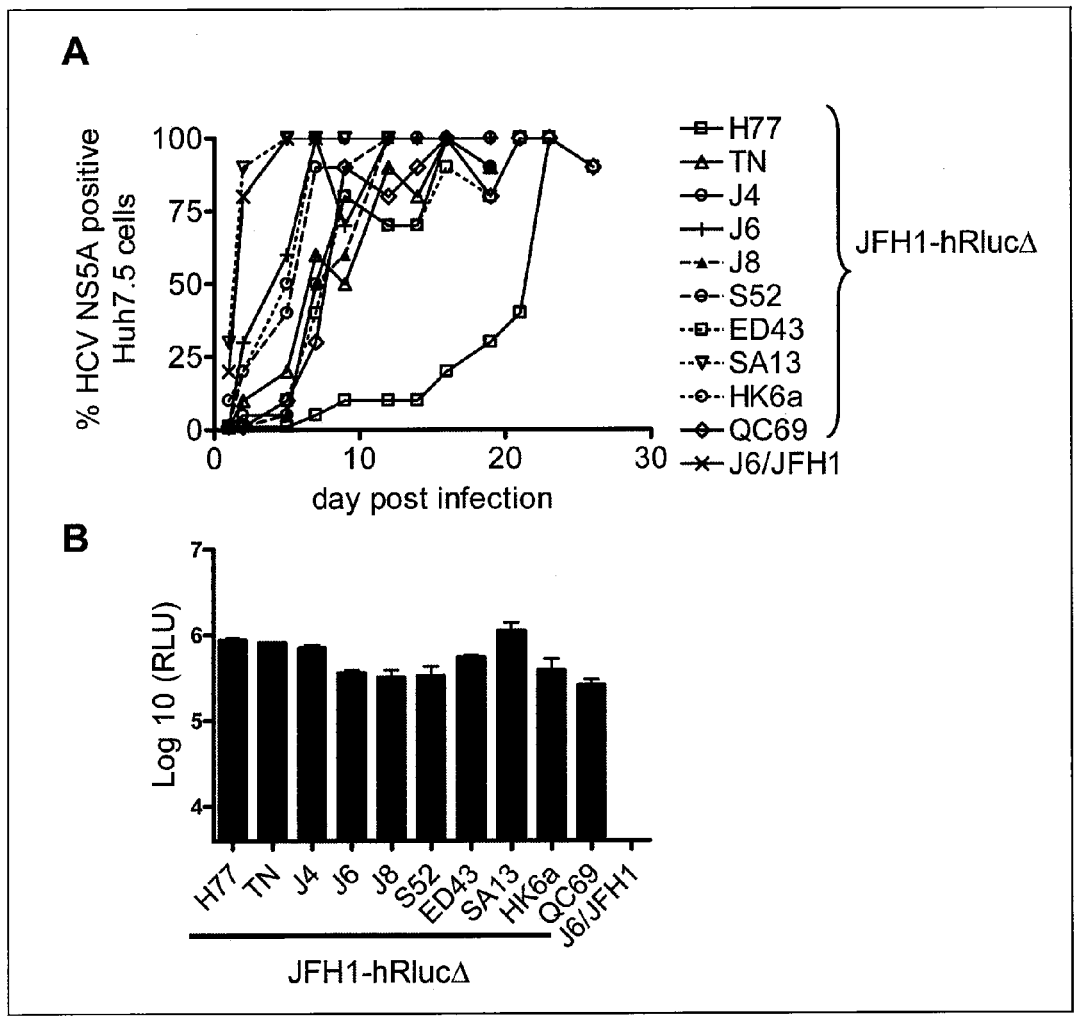

The present inventors developed a panel of hRLuc reporter viruses of JFH1-based recombinants with Core-NS2 of the major HCV genotypes. RNA transcripts of the following plasmids were transfected into Huh7.5 cells: pH77/JFH1 (T2700C,A4080T)-hRlucΔ (SEQ ID NO: 80, encoded amino acid has SEQ ID NO: 100); pTN/JFH1(T2700C,A4080T)-hRluc (SEQ ID NO: 81, encoded amino acid has SEQ ID NO: 101); pJ4/JFH1(T2996C,A4827T)-hRluc (SEQ ID NO: 82, encoded amino acid has SEQ ID NO: 102); pJ6/JFH1-hRluc (SEQ ID NO: 10, encoded amino acid has SEQ ID NO: 20); pJ8/JFH1-hRluc (SEQ ID NO: 83, encoded amino acid has SEQ ID NO: 103); pS52/JFH1(T2718G,A4550C)-hRluc (SEQ ID NO: 84, encoded amino acid has SEQ ID NO: 104); pED43/JFH1(A2819G,A3269T)-hRlucΔ (SEQ ID NO: 85, encoded amino acid has SEQ ID NO: 105); pSA13/JFH1 (C3405G,A3696G)-hRluc (SEQ ID NO: 86, encoded amino acid has SEQ ID NO: 106); pHK6a/JFH1(T1389C,A1590C)-hRluc (SEQ ID NO: 87, encoded amino acid has SEQ ID NO: 107); pQC69/JFH1(T2985C,C9234T)-hRluc (SEQ ID NO: 88, encoded amino acid has SEQ ID NO: 108); and pJ6/JFH1 as positive control. This led in all cases to viral infection that spread to the complete culture in 7-14 days (FIG. 12 A). At peak of infection, relatively high infectivity titers were found in supernatants from transfection cultures (Table 3). At peak of infection, lysates of transfected cells showed luminescence, indicating presence of hRluc reporter gene (FIG. 12 B). Supernatants from time points with peak infection in transfection cultures were used for passage in naïve Huh7.5 cells (FIG. 13). 3 ml of transfection culture supernatant was used to infect naïve Huh7.5 cells. All viruses spread to the complete cell culture; different spread kinetics are most probably due to differential input dose (FIG. 13 A). At the peak of infection of this 1$^{st}$ passage experiment, a strong luminescence signal was detected for all genotype recombinants in lysates of infected cells, confirming presence and activity of the hRluc reporter (FIG. 13B). The present inventors commenced direct sequence analysis of the complete open reading frame of viral genomes derived from 1$^{st}$ passage cell culture supernatants at the peak of infection. At the time point of submission of this document, the data were not completed. However, the present inventors confirmed that the hRluc reporter sequence was maintained in hRlucΔ recombinants with Core-NS2 of the different genotype isolates tested. This is in contrast to J6/JFH1-hRluc, which deleted hRluc gene in one experiment (FIG. 10 A, B). For viral genomes of H77/JFH1(T2700C,A4080T)-hRlucΔ (SEQ ID NO: 80); HK6a/JFH1(T1389C,A1590C)-hRlucΔ (SEQ ID NO: 87); and QC69/JFH1(T2985C,C9234T)-hRlucΔ (SEQ ID NO: 88) direct sequence analysis of the entire ORF was completed, these viruses did not show major adaptive mutations (meaning complete change of one nucleotide to another nucleotide) Thus, the present inventors developed a panel of hRluc reporter viruses with Core-NS2 of all major HCV genotypes.

Figure 14:
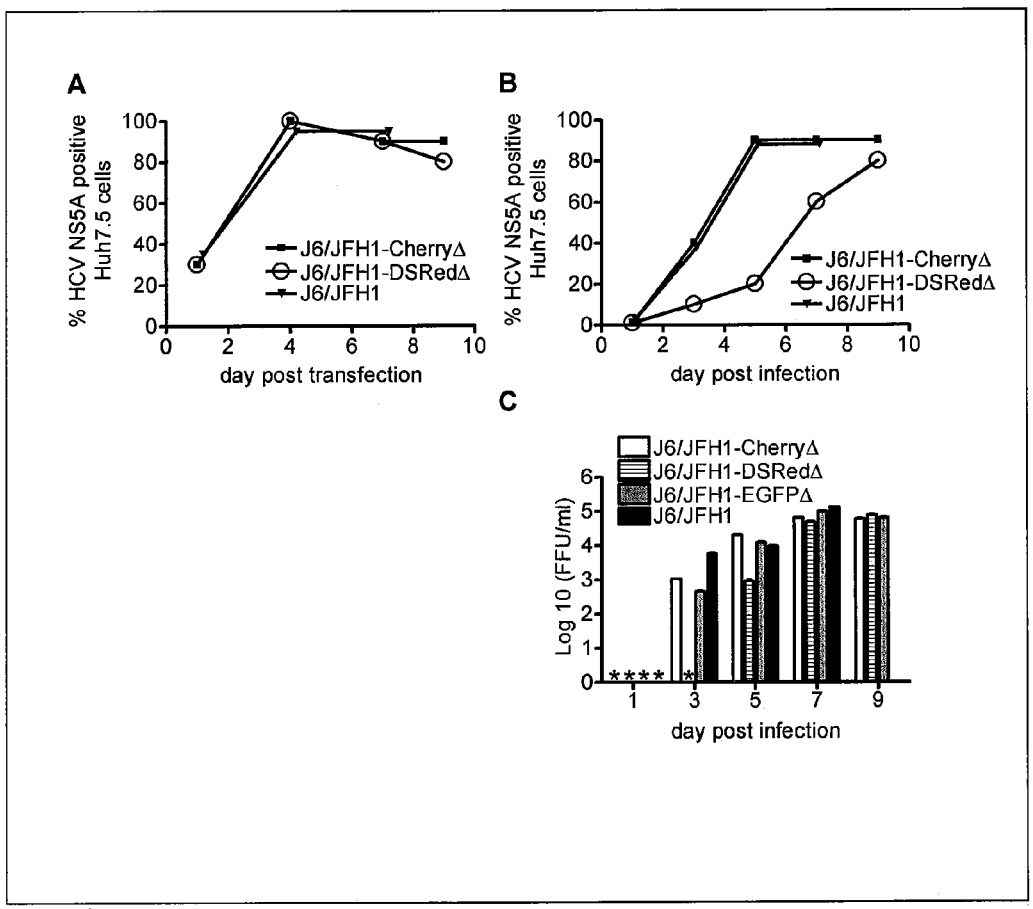

The inventors of the present invention also tested, if the identified deletion (encoded by nt 7016-7135, leading to deletion of JFH1 NS5A aa 250-289) allowed insertion of other reporter genes in J6/JFH1. Thus, the inventors generated pJ6/JFH1-CherryΔ (SEQ ID NO: 78, encoding amino acid sequence of SEQ ID NO: 98) and pJ6/JFH1-DSRedΔ (SEQ ID NO: 79, encoding amino acid sequence of SEQ ID NO: 99) by insertion of red fluorescent proteins, either mCherry or DSRed Express2, immediately downstream of codon 418 in J6/JFH1 NS5A. After transfection of RNA transcripts, J6/JFH1-CherryΔ and J6/JFH1-DSRedΔ infected the complete cell culture on day 4, comparable to J6/JFH1 (FIG. 14 A). Red fluorescence was detectable with a fluorescent microscope. After infection of naïve Huh7.5 cells with the same infectious dose of each virus, rapid viral spread occurred (FIG. 14 B). Peak infectivity titers of J6/JFH1-CherryΔ and J6/JFH1-DSRedΔ were between 4.5-5 logs FFU/ml, comparable to those of J6/JFH1 (FIG. 14 C).

Figure 6:
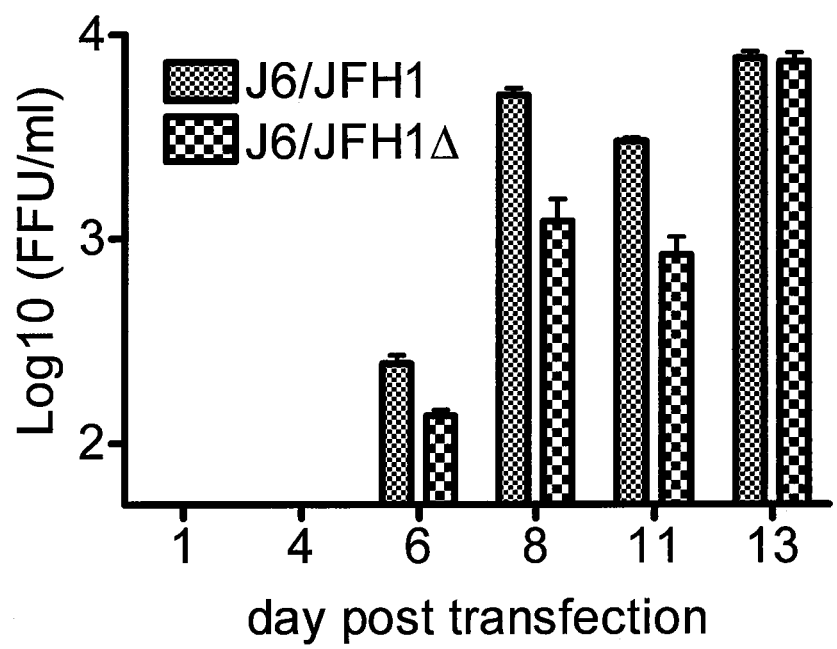

The present inventors aimed at investigating the importance of the 40 amino acid deletion (encoded by nt 7016-7135 and thus JFH1 NS5A aa 250-289), identified after transfection of J6/JFH1-EGFP (FIG. 1A), for J6/JFH viability. Thus, J6/JFH1Δ with deletion of these nucleotides was constructed. After transfection of Huh7.5 cells, J6/JFH1Δ spread as efficiently as J6/JFH (FIG. 5) and yielded supernatant infectivity titers comparable to J6/JFH1 (FIG. 6). Thus, viability of J6/JFH1 was not impaired by the deletion conferring viability to J6/JFH1-EGFP, J6/JFH1-hRLuc, J6/JFH1-Cherry, and J6/JFH1-DSRed. Viability of J6/JFH1Δ was also tested in the SCID-uPA mouse model. After inoculation of a SCID-uPA mouse with a J6/JFH1Δ virus stock from a first passage experiment (derived from the transfection experiment shown in FIGS. 5 and 6), this mouse became infected. By direct sequence analysis of viral genomes contained in the serum of the infected SCID-uPA mouse, we confirmed the identity of J6/JFH1Δ. Thus, J6/JFH1Δ was also viable in vivo.

Figure 7:
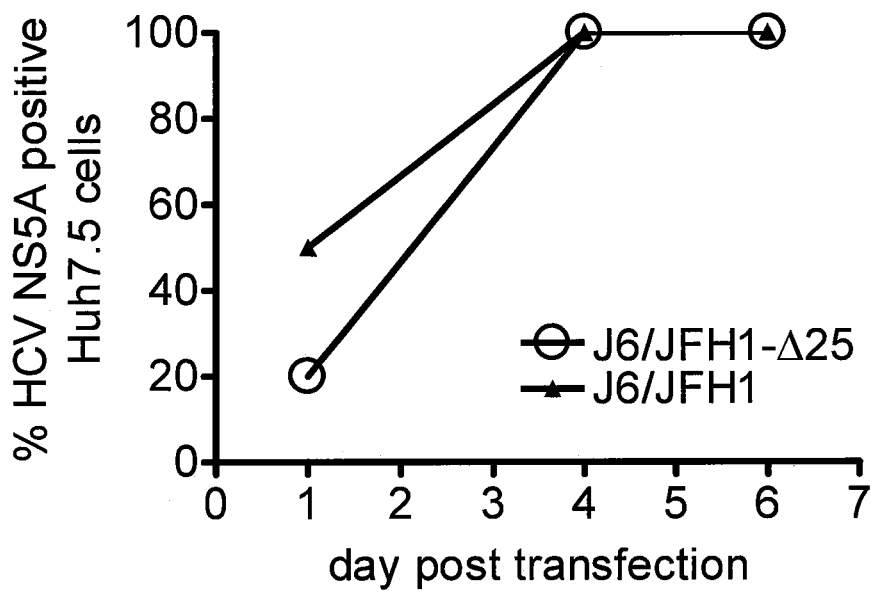

The inventors of the present invention also tested the impact of the 25 amino acid deletion (nucleotide position 7065-7139 corresponding to amino acid position 266 to 290) identified after transfection of J6/JFH1-EGFP (FIG. 1B) on J6/JFH1. In a transfection experiment, both J6/JFH1 and J6/JFHΔ25 spread with similar kinetics (FIG. 7), indicating, that this deletion did not either impair viability of J6/JFH1.

Thus, the invention provides a replicating RNA by introduction of a modified HCV NS5A protein with an identified deletion and a reporter gene such as EGFP and hRLuc. Viable EGFP and hRLuc reporter viruses for JFH1-based intergenotypic recombinants of prototype isolates of genotypes 1a, 1b, 2a, 2b, 3a, 4a, 5a, 6a, and 7a were developed. J6/JFH recombinants containing an identified deletion and mCherry or DSRed Express2 (J6/JFH1-CherryΔ, J6/JFH1-DSRedΔ) at the same position as in J6/JFH1-EGFPΔ, were viable in cell culture, thus allowing for development of red fluorescent protein-tagged reporter viruses.

Such hepatitis C reporter viruses greatly facilitate detection of the tagged virus. EGFP and red fluorescent proteins can easily be detected by fluorescence-based techniques such as flow cytometry, fluorescence microscopy or by fluorescence plate readers. Luciferase is detected by luminescence based techniques, e.g. in suitable plate readers. Thus, the developed viruses facilitate high-throughput analysis, as required for screening of new antivirals and vaccine candidates and analysis of patient samples.

Several types of reporter genes are available for use in the construction of reporter (or bioreporter) organisms, and the signals they generate can usually be categorized as colorimetric, fluorescent, luminescent, chemiluminescent or electrochemical. Although each functions differently, their end product always remains the same—a measurable signal that is proportional to the concentration of the unique chemical or physical agent to which they have been exposed. In some instances, the signal only occurs when a secondary substrate is added to the bioassay (luxAB, Luc, and aequorin). For other bioreporters, the signal must be activated by an external light source (GFP and UMT), and for a selected few bioreporters, the signal is completely self-induced, with no exogenous substrate or external activation being required (luxCDABE).

Thus, fluorescent proteins include any proteins that can be used in which the molecular absorption of a photon triggers the emission of another photon with a longer wavelength. The energy difference between the absorbed and emitted photons ends up as molecular vibrations or heat. Usually the absorbed photon is in the ultraviolet range, and the emitted light is in the visible range. Examples of fluorescent proteins include different variants of green fluorescent protein (GFP, EGFP etc.), red fluorescent proteins (e.g. Cherry, DSRed, Katuschka), yellow fluorescent proteins, and cyan fluorescent proteins.

Luminescent (or bioluminescent) proteins include proteins which causes the production and emission of light by a living organism as the result of a chemical reaction during which chemical energy is converted to light energy. Usually less than 20% of the light generates thermal radiation in luminescence. It should not be confused with fluorescence. Examples of luminescent proteins include different types of luciferase and genes of the lux cassette e.g. luxCDABE bioreporters.

Also, bioreporter or biosensor proteins like the enzyme glucose oxidase, secreted alkaline phosphatase (SEAP), or antibiotic resistance proteins, that do not produce a visible signal, could be used as a possible tag.

Further, the developed reporter viruses facilitate basic research. Many studies, such as receptor blocking studies, can be carried out in a more economical and timesaving manner. Visualization of NS5A-EGFP or NS5A-red fluorescent protein fusion protein by fluorescent microscopy allows determination of the intracellular localization and interaction partners of NS5A.

Live confocal imaging could reveal further details about the viral life cycle, such as determination of length of the interval between infection and expression of NS5A and its redistribution to certain intracellular compartments. In addition, EGFP and red fluorescent reporter viruses facilitate monitoring of HCV infection in vivo, in the SCID-uPA or the chimpanzee animal model.

Thus, the percentage and localization of infected liver cells could be readily monitored. It would also be possible to screen for extra hepatic sites of HCV infection, a research area, which so far has been difficult to tackle but is of interest, since HCV infection is associated with several extra hepatic manifestations. At last, analysis of the described deletion, and another deletion, also identified in J6/JFH1-EGFP passage virus, could clarify the function of this region in HCV NS5A.

Thus, one embodiment of the invention relates to replicating RNA comprising the structural genes (Core, E1, E2), p7, and the non structural gene NS2 or at least part of the non-structural gene NS2 of genotype 1a, 1b, 2a, 2b, 3a, 4a, 5a, 6a or 7a and the non-structural genes NS3, NS4A, NS4B, NS5A and NS5B from the JFH1 strain and wherein a reporter gene is inserted in domain III of the non-structural gene NS5A and further comprising a deletion in the non-structural gene NS5A, wherein the reporter gene is selected from the group consisting of colorimetric, fluorescent, luminescent, chemiluminescent or electrochemical proteins.

Thus, in a further embodiment of the invention relates to replicating RNA comprising the structural genes (Core, E1, E2), p7, and the non structural gene NS2 or at least part of the non-structural gene NS2 of genotype 1a, 1b, 2a, 2b, 3a, 4a, 5a, 6a or 7a and the non-structural genes NS3, NS4A, NS4B, NS5A and NS5B, and untranslated regions, from the JFH1 strain and wherein a reporter gene is inserted in domain III of the non-structural gene NS5A and further comprising a deletion in the non-structural gene NS5A, wherein the reporter gene is selected from the group consisting of colorimetric, fluorescent, luminescent, chemiluminescent or electrochemical proteins.

In another embodiment the replicating RNA of genotype 1a is of the strain H77, TN, or DH6, the genotype 1b is of the strain J4, DH1 or DH5, the genotype 2a is of the strain J6, the genotype 2b is of the strain J8, the genotype 3a is of the strain S52 or DBN, the genotype 4a is of the strain ED43, the genotype 5a is of the strain SA13, the genotype 6a is of the strain HK6a, and the genotype 7a is of the strain QC69

It is to be understood that various other non-specified HCV strains may be used to construct similar JFH-1 recombinants. Amino Acid Sequences, without Adaptive Mutations, all Reporter Viruses, Construct Names.

An embodiment of the invention relates to an isolated nucleic acid molecule which encodes human hepatitis C virus of strain selected from the group consisting of H77/JFH1-EGFPΔ (1a/2a), TN/JFH1-EGFPΔ (1a/2a), J4/JFH1-EGFPΔ (1b/2a), J6/JFH1-EGFPΔ (2a/2a), J8/JFH1-EGFPΔ (2b/2a), S52/JFH1-EGFPΔ (3a/2a), ED43/JFH1-EGFPΔ (4a/2a), SA13/JFH1-EGFPΔ (5a/2a), HK6a/JFH1-EGFPΔ (6a/2a), J6/JFH1-CherryΔ (2a/2a), J6/JFH1-DsRedΔ (2a/2a), J6/JFH1-hRlucΔ (2b/2a), J8/JFH1-hRlucΔ (2b/2a), H77/JFH1-hRlucΔ (1a/2a), TN/JFH1-hRlucΔ (1a/2a), J4/JFH1-hRlucΔ (1b/2a), S52/JFH1-hRlucΔ (3a/2a), ED43/JFH1-hRlucΔ (4a/2a), SA13/JFH1-hRlucΔ (5a/2a), HK6a/JFH1-hRlucΔ (6a/2a), QC69/JFH1-hRlucΔ (7a/2a) or QC69/JFH1-EGFPΔ (7a/2a), wherein H77/JFH1-EGFPΔ (1a/2a) encodes the amino acid sequence with a sequence identity of at least 90% to that of SEQ ID NO: 11, wherein J4/JFH1-EGFPΔ (1b/2a) encodes the amino acid sequence with a sequence identity of at least 90% to that of SEQ ID NO: 12, wherein J6/JFH1-EGFPΔ (2a/2a) encodes the amino acid sequence with a sequence identity of at least 90% to that of SEQ ID NO: 13, wherein J8/JFH1-EGFPΔ (2b/2a) encodes the amino acid sequence with a sequence identity of at least 90% to that of SEQ ID NO: 14, wherein S52/JFH1-EGFPΔ (3a/2a) encodes the amino acid sequence with a sequence identity of at least 90% to that of SEQ ID NO: 15, wherein ED43/JFH1-EGFPΔ (4a/2a) encodes the amino acid sequence with a sequence identity of at least 90% to that of SEQ ID NO: 16, wherein SA13/JFH1-EGFPΔ (5a/2a) encodes the amino acid sequence with a sequence identity of at least 90% to that of SEQ ID NO: 17, wherein HK6a/JFH1-EGFPΔ (6a/2a) encodes the amino acid sequence with a sequence identity of at least 90% to that of SEQ ID NO: 18, wherein J6/JFH1-CherryΔ (2a/2a) encodes the amino acid sequence with a sequence identity of at least 90% to that of SEQ ID NO: 98, wherein J6/JFH1-DsRedΔ encodes the amino acid sequence with a sequence identity of at least 90% to that of SEQ ID NO: 99, wherein J6/JFH1-hRlucΔ (2b/2a) encodes the amino acid sequence with a sequence identity of at least 90% to that of SEQ ID NO: 20; wherein J8/JFH1-hRlucΔ encodes the amino acid sequence with a sequence identity of at least 90% to that of SEQ ID NO: 103, wherein TN/JFH1-EGFPΔ (1a/2a) encodes the amino acid sequence with a sequence identity of at least 90% to that of SEQ ID NO: 120, wherein H77/JFH1-hRlucΔ encodes the amino acid sequence with a sequence identity of at least 90% to that of SEQ ID NO: 129, wherein TN/JFH1-hRlucΔ encodes the amino acid sequence with a sequence identity of at least 90% to that of SEQ ID NO: 130, wherein J4/JFH1-hRlucΔ encodes the amino acid sequence with a sequence identity of at least 90% to that of SEQ ID NO: 131, wherein S52/JFH1-hRlucΔ encodes the amino acid sequence with a sequence identity of at least 90% to that of SEQ ID NO: 132, wherein ED43/JFH1-hRlucΔ (4a/2a) encodes the amino acid sequence with a sequence identity of at least 90% to that of SEQ ID NO: 133 wherein SA13/JFH1-hRlucΔ (5a/2a) encodes the amino acid sequence with a sequence identity of at least 90% to that of SEQ ID NO: 134, wherein HK6a/JFH1-hRlucΔ (6a/2a) encodes the amino acid sequence with a sequence identity of at least 90% to that of SEQ ID NO: 135, wherein QC69/JFH1-hRlucΔ (7a/2a) encodes the amino acid sequence with a sequence identity of at least 90% to that of SEQ ID NO: 136, and wherein QC69/JFH1-EGFPΔ (7a/2a) encodes the amino acid sequence with a sequence identity of at least 90% to that of SEQ ID NO: 19.
Amino Acid Sequences, without Adaptive Mutations, all Reporter Viruses, SEQ ID Numbers In another embodiment, the amino acid comprises a sequence sharing at least 90% identity with that set forth in SEQ ID NO: 11 or SEQ ID NO: 12 or SEQ ID NO: 13 or SEQ ID NO: 14 or SEQ ID NO: 15 or SEQ ID NO: 16 or SEQ ID NO: 17 or SEQ ID NO: 18 or SEQ ID NO: 19 or SEQ ID NO: 20 or SEQ ID NO: 103, or SEQ ID NO: 98 or SEQ ID NO: 99 or SEQ ID NO: 120 or SEQ ID NO: 129 or SEQ ID NO: 130 or SEQ ID NO: 131 or SEQ ID NO: 132 or SEQ ID NO: 133 or SEQ ID NO: 134 or SEQ ID NO: 135 or SEQ ID NO: 136, such as 90% identity, 91% identity, 92% identity, 93% identity, 94% identity, 95% identity, 96% identity, 97% identity, 98% identity, or 99% identity.
Amino Acid Sequences, with Adaptive Mutations, EGFP Viruses, SEQ ID Numbers.

An embodiment of the present invention relates to the amino acid sequences with adaptive mutations according to SEQ ID NO: 89 or SEQ ID NO: 90 or SEQ ID NO: 91 or SEQ ID NO: 92 or SEQ ID NO: 93 or SEQ ID NO: 94 or SEQ ID NO: 95 or SEQ ID NO: 96 or SEQ ID NO: 97, or an amino acid sequence sharing at least 90% identity with that set forth in SEQ ID NO: 89 or SEQ ID NO: 90 or SEQ ID NO: 91 or SEQ ID NO: 92 or SEQ ID NO: 93 or SEQ ID NO: 94 or SEQ ID NO: 95 or SEQ ID NO: 96 or SEQ ID NO: 97, such as 90% identity, 91% identity, 92% identity, 93% identity, 94% identity, 95% identity, 96% identity, 97% identity, 98% identity, or 99% identity.

Amino Acid Sequences, with Adaptive Mutations, hRluc Viruses, SEQ ID Numbers.

An embodiment of the present invention relates to the amino acid sequences with adaptive mutations according to SEQ ID NO: 100 or SEQ ID NO: 101 or SEQ ID NO: 102 or SEQ ID NO: 104 or SEQ ID NO: 105 or SEQ ID NO: 106 or SEQ ID NO: 107 or SEQ ID NO: 108, or a nucleic acid sequence sharing at least 90% identity with that set forth in SEQ ID NO: 100 or SEQ ID NO: 101 or SEQ ID NO: 102 or SEQ ID NO: 104 or SEQ ID NO: 105 or SEQ ID NO: 106 or SEQ ID NO: 107 or SEQ ID NO: 108, such as 90% identity, 91% identity, 92% identity, 93% identity, 94% identity, 95% identity, 96% identity, 97% identity, 98% identity, or 99% identity.

Amino Acid Sequence, no Mutations, J6/JFH1 hRlucΔ.

In a further embodiment the invention relates to an isolated nucleic acid molecule, which encodes human hepatitis C virus of strain J6/JFH1-HRlucΔ (2a/2a) encodes the amino acid sequence with a sequence identity of at least 90% to that of SEQ ID NO: 20.

Amino Acid Sequence, no Mutations, TN/JFH1-EGFPΔ.

In a further embodiment the invention relates to an isolated nucleic acid molecule, which encodes human hepatitis C virus of strain TN/JFH1-EGFPΔ encodes the amino acid sequence with a sequence identity of at least 90% to that of SEQ ID NO: 120.

Amino Acid Sequences, J6/JFH1-CherryΔ.

In a further embodiment the invention relates to an isolated nucleic acid molecule, which encodes human hepatitis C virus of strain J6/JFH1-CherryΔ encodes the amino acid sequence with a sequence identity of at least 90% to that of SEQ ID NO: 98.

Amino Acid Sequences, J6/JFH1-DSRedΔ.

In a further embodiment the invention relates to an isolated nucleic acid molecule, which encodes human hepatitis C virus of strain J6/JFH1-DSRedΔ encodes the amino acid sequence with a sequence identity of at least 90% to that of SEQ ID NO: 99.

Nucleotide Acid Sequences, without Adaptive Mutations, all Reporter Viruses, Construct Names.

An embodiment of the invention relates to an isolated nucleic acid molecule, which encodes human hepatitis C virus of strain selected from the group consisting of: H77/JFH1-EGFPΔ (1a/2a), J4/JFH1-EGFPΔ (1b/2a), J6/JFH1-EGFPΔ (2a/2a), J8/JFH1-EGFPΔ (2b/2a), S52/JFH1-EGFPΔ (3a/2a), ED43/JFH1-EGFPΔ (4a/2a), SA13/JFH1-EGFPΔ (5a/2a), HK6a/JFH1-EGFPΔ (6a/2a) or QC69/JFH1-EGFPΔ (7a/2a), J6/JFH1-CherryΔ (2a/2a), J6/JFH1-DsRedΔ (2a/2a), J6/JFH1-hRlucΔ (2a/2a), J8/JFH1-hRlucΔ (2b/2a), TN/JFH1-EGFPΔ (1a/2a), H77/JFH1-hRlucΔ (1a/2a), TN/JFH1-hRlucΔ (1a/2a), J4/JFH1-hRlucΔ (1b/2a), S52/JFH1-hRlucΔ (3a/2a), ED43/JFH1-hRlucΔ (4a/2a), SA13/JFH1-hRlucΔ (5a/2a), HK6a/JFH1-hRlucΔ (6a/2a), QC69/JFH1-hRlucΔ (7a/2a), wherein H77/JFH1-EGFPΔ (1a/2a) encodes the nucleic acid sequence with a sequence identity of at least 90% to that of SEQ ID NO: 1, wherein J4/JFH1-EGFPΔ (1b/2a) encodes the nucleic acid sequence with a sequence identity of at least 90% to that of SEQ ID NO: 2, wherein J6/JFH1-EGFPΔ (2a/2a) encodes the nucleic acid sequence with a sequence identity of at least 90% to that of SEQ ID NO: 3, wherein J8/JFH1-EGFPΔ (2b/2a) encodes the nucleic acid sequence with a sequence identity of at least 90% to that of SEQ ID NO: 4, wherein S52/JFH1-EGFPΔ (3a/2a) encodes the nucleic acid sequence with a sequence identity of at least 90% to that of SEQ ID NO: 5, wherein ED43/JFH1-EGFPΔ (4a/2a) encodes the nucleic acid sequence with a sequence identity of at least 90% to that of SEQ ID NO: 6, wherein SA13/JFH1-EGFPΔ (5a/2a) encodes the nucleic acid sequence with a sequence identity of at least 90% to that of SEQ ID NO: 7, wherein HK6a/JFH1-EGFPΔ (6a/2a) encodes the nucleic acid sequence with a sequence identity of at least 90% to that of SEQ ID NO: 8, wherein J6/JFH1-CherryΔ (2a/2a) encodes the nucleic acid sequence with a sequence identity of at least 90% to that of SEQ ID NO: 78, wherein J6/JFH1-DsRedΔ encodes the nucleic c acid sequence with a sequence identity of at least 90% to that of SEQ ID NO: 79, wherein J6/JFH1-hRlucΔ encodes the nucleic acid sequence with a sequence identity of at least 90% to that of SEQ ID NO: 10, wherein J8/JFH1-hRlucΔ encodes the nucleic acid sequence with a sequence identity of at least 90% to that of SEQ ID NO: 83, wherein TN/JFH1-EGFPΔ (1a/2a) encodes the nucleic acid sequence with a sequence identity of at least 90% to that of SEQ ID NO: 119, wherein H77/JFH1-hRlucΔ encodes the nucleic acid sequence with a sequence identity of at least 90% to that of SEQ ID NO: 121, wherein TN/JFH1-hRlucΔ encodes the nucleic acid sequence with a sequence identity of at least 90% to that of SEQ ID NO: 122, wherein J4/JFH1-hRlucΔ encodes the nucleic acid sequence with a sequence identity of at least 90% to that of SEQ ID NO: 123, wherein S52/JFH1-hRlucΔ encodes the nucleic acid sequence with a sequence identity of at least 90% to that of SEQ ID NO: 124, wherein ED43/JFH1-hRlucΔ (4a/2a) encodes the nucleic acid sequence with a sequence identity of at least 90% to that of SEQ ID NO: 125, wherein SA13/JFH1-hRlucΔ (5a/2a) encodes the nucleic acid sequence with a sequence identity of at least 90% to that of SEQ ID NO: 126, wherein HK6a/JFH1-hRlucΔ (6a/2a) encodes the nucleic acid sequence with a sequence identity of at least 90% to that of SEQ ID NO: 127, wherein QC69/JFH1-hRlucΔ (7a/2a) encodes the nucleic acid sequence with a sequence identity of at least 90% to that of SEQ ID NO: 128, and wherein QC69/JFH1-EGFPΔ (7a/2a) encodes the nucleic acid sequence with a sequence identity of at least 90% to that of SEQ ID NO: 9.

Nucleotide Acid Sequence, without Adaptive Mutations, all Reporter Viruses, SEQ ID Numbers.

In another embodiment, the nucleic acid comprises a sequence sharing at least 90% identity with that set forth in SEQ ID NO: 1 or SEQ ID NO: 2 or SEQ ID NO: 3 or SEQ ID NO: 4 or SEQ ID NO: 5 or SEQ ID NO: 6 or SEQ ID NO: 7 or SEQ ID NO: 8 or SEQ ID NO: 9 or SEQ ID NO: 10 or SEQ ID NO: 78 or SEQ ID NO: 79 or SEQ ID NO: 83 or SEQ ID NO: 119 or SEQ ID NO: 121 or SEQ ID NO: 122 or SEQ ID NO: 123 or SEQ ID NO: 124 or SEQ ID NO: 125 or SEQ ID NO: 126 or SEQ ID NO: 127 or SEQ ID NO: 128, such as 90% identity, 91% identity, 92% identity, 93% identity, 94% identity, 95% identity, 96% identity, 97% identity, 98% identity, or 99% identity.

Nucleotide Acid Sequences, with Adaptive Mutations, EGFP Viruses, SEQ ID Numbers.

An embodiment of the present invention relates to the nucleic acid sequences with adaptive mutations according to SEQ ID NO: 69 or SEQ ID NO: 70 or SEQ ID NO: 71 or SEQ ID NO: 72 or SEQ ID NO: 73 or SEQ ID NO: 74 or SEQ ID NO: 75 or SEQ ID NO: 76 or SEQ ID NO: 77, or a nucleic acid sequence sharing at least 90% identity with that set forth in SEQ ID NO: 69 or SEQ ID NO: 70 or SEQ ID NO: 71 or SEQ ID NO: 72 or SEQ ID NO: 73 or SEQ ID NO: 74 or SEQ ID NO: 75 or SEQ ID NO: 76 or SEQ ID NO: 77, such as 90% identity, 91% identity, 92% identity, 93% identity, 94% identity, 95% identity, 96% identity, 97% identity, 98% identity, or 99% identity.

Nucleotide Acid Sequences, with Adaptive Mutations, hRluc Viruses, SEQ ID Numbers.

An embodiment of the present invention relates to the nucleic acid sequences with adaptive mutations according to SEQ ID NO: 80 or SEQ ID NO: 81 or SEQ ID NO: 82 or SEQ ID NO: 84 or SEQ ID NO: 85 or SEQ ID NO: 86 or SEQ ID NO: 87 or SEQ ID NO: 88, or a nucleic acid sequence sharing at least 90% identity with that set forth in SEQ ID NO: 80 or SEQ ID NO: 81 or SEQ ID NO: 82 or SEQ ID NO: 84 or SEQ ID NO: 85 or SEQ ID NO: 86 or SEQ ID NO: 87 or SEQ ID NO: 88, such as 90% identity, 91% identity, 92% identity, 93% identity, 94% identity, 95% identity, 96% identity, 97% identity, 98% identity, or 99% identity.

Nucleotide Acid Sequence, J6/JFH1hRlucΔ.

In a further embodiment the invention relates to an isolated nucleic acid molecule, which encodes human hepatitis C virus of strain J6/JFH1-hRlucΔ (2a/2a) encodes the nucleic acid sequence with a sequence identity of at least 90% to that of SEQ ID NO: 10.

In a further embodiment, the isolated nucleic acid molecule provided by the present invention is capable of infectivity in vivo.

Another embodiment of the invention relates to a cassette vector for cloning viral genomes, comprising, inserted therein, the nucleic acid sequences of the invention and having an active promoter upstream thereof.

Untranslated Regions

The 5' untranslated region (UTR) is the most conserved region of the hepatitis C virus (HCV) genome. It is composed of ~341 nucleotides, which form the structurally conserved domains I, II, III and IV important for replication and translation. Domains I and II are sufficient for viral RNA replication, and domains II, III and IV together with the first 12 to 30 nt of the core-coding region constitute the internal ribosome entry site (IRES) that directs cap-independent translation of the open reading frame (ORF). The study of replication of the HCV genome has been previously limited due to lack of a supporting cell culture system. Previous evidence, revealing the importance of the 5'UTR in replication and translation, was based on studies in subgenomic replicon systems. This system itself has the limitation that it only allows studies of RNA replication, while other important steps of the viral life cycle, such as virus packaging, assembly and release, cannot be studied. Thus, although studies in the replicon systems have provided significant advance in our knowledge of secondary structure, RNA-RNA interaction and functional importance of the 5'UTR, the relevance of replicon systems to study HCV infection is unclear, and more importantly they do not permit analysis of the complete viral life cycle.

Previously developed JFH1-based intergenotypic HCV genotype 1-7 cell culture system permit for the first time to study the role of Core, E1, E2, p7, and NS2 of all genotypes during the full viral life cycle. However, all these intergenotypic viruses contain the genotype 2a 5'UTR (JFH1 isolate) and the mechanisms of their replication are still unknown. It has been assumed that the replication of these intergenotypic viruses might be attributed to the genotype specific interaction of JFH1 5' and 3'UTR. This has limited their use in genotype specific studies of HCV replication, translation and functional parts of the 5'UTR. Other studies based on the replicon system have proposed that the HCV 5'UTR contains genotype specific signal elements. This question could be addressed by use of the invented viruses. Current therapy using interferon and ribavirin is high cost, has substantial side effects and is only effective in about 50% of the treated genotype 1 infected patients. There is no vaccine available for hepatitis C, and more effective therapeutic drugs are therefore required. Since the 5'UTR could be a target for interferon and the IRES might contribute to IFN resistance, the viruses could therefore contribute to individualized treatment of patients. In addition, various host cell factors interact with the 5'UTR, thus drugs interfering with such host cell factors could also be tested.

To meet these needs, the present inventors have developed new intergenotypic JFH1-based HCV recombinants containing genotype-specific 5'UTRs. The inventors of the present invention replaced the original JFH1 5'UTR of JFH-1 based Core-NS2 recombinants of HCV genotypes 1a, 1b, 2a, 2b, 3a, 4a, 5a and 6a with homologous 5'UTRs.

Figure 15:
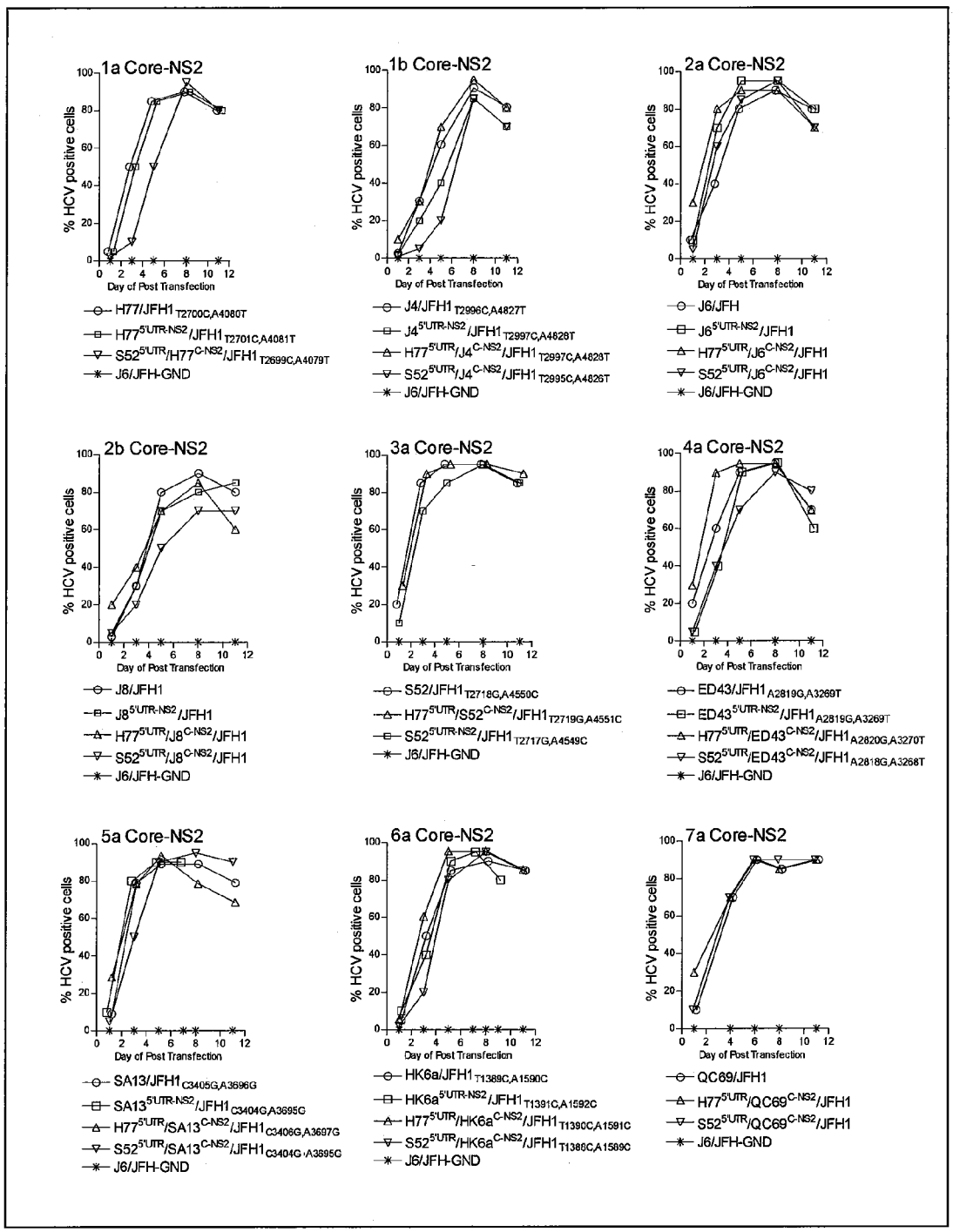
Figure 18:
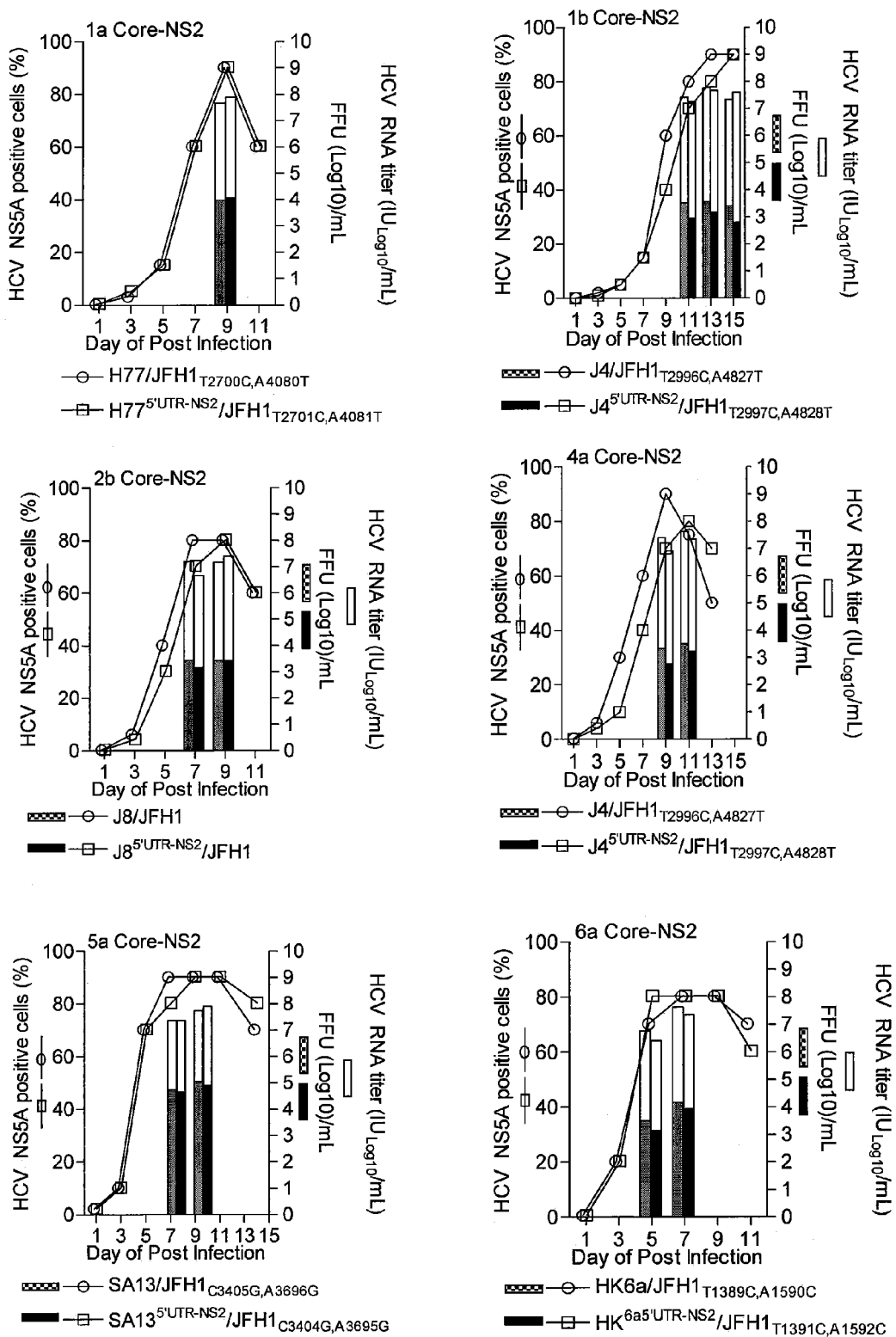

In another set of recombinants, the present inventors replaced the original JFH1 5'UTR of JFH1-based Core-NS2 recombinants of HCV genotypes 1a, 1b, 2a, 2b, 3a, 4a, 5a, 6a and 7a with the heterologous 5'UTR from 1a (H77) and 3a (S52) viruses. These chimera viruses thus consist of either homologous 5'UTR or heterologous 5'UTR of genotype 1a or 3a, Core-NS2 portion of respective genotype, followed by JFH1 sequences NS3-3'UTR. Following transfection into human hepatoma cell line Huh7.5 cells, viruses with Core-NS2 of a given genotype isolate with either homotypic 5'UTR or heterotypic genotype 1a (strain H77) or genotype 3a (strain S52) 5'UTR spread as efficiently as the respective Core-NS2 recombinant with the JFH1 5'UTR (FIG. 15). Infectivity titers of Core-NS2 recombinants with either homotypic or heterotypic 1a (H77) or 3a (S52) 5'UTR were also comparable to those of the respective recombinant with JFH1 5'UTR (Table 4, FIG. 17). After passage of transfection culture supernatant to naïve Huh7.5 cells, JFH1-based recombinants with Core-NS2 of genotypes 1a, 1b, 2b, 4a, 5a and 6a with genotype-specific homotypic 5'UTR were comparable to the respective recombinants with JFH1 5'UTR with respect to virus-spread kinetics, RNA and infectivity titers (FIG. 18). Genomes from this viral passage experiment were directly sequenced. JFH1-based recombinants with Core-NS2 of genotype 1-6 with genotype-specific homotypic 5'UTRs and heterotypic genotype 1a and 3a 5'UTRs did not require adaptation in cell culture, with exception of a change found at nucleotide 1 of the 5'UTR of genotype 1a, 1b, 2b, 3a and 6a, which apparently required residue A instead of the original G (FIG. 19).

Figure 20:
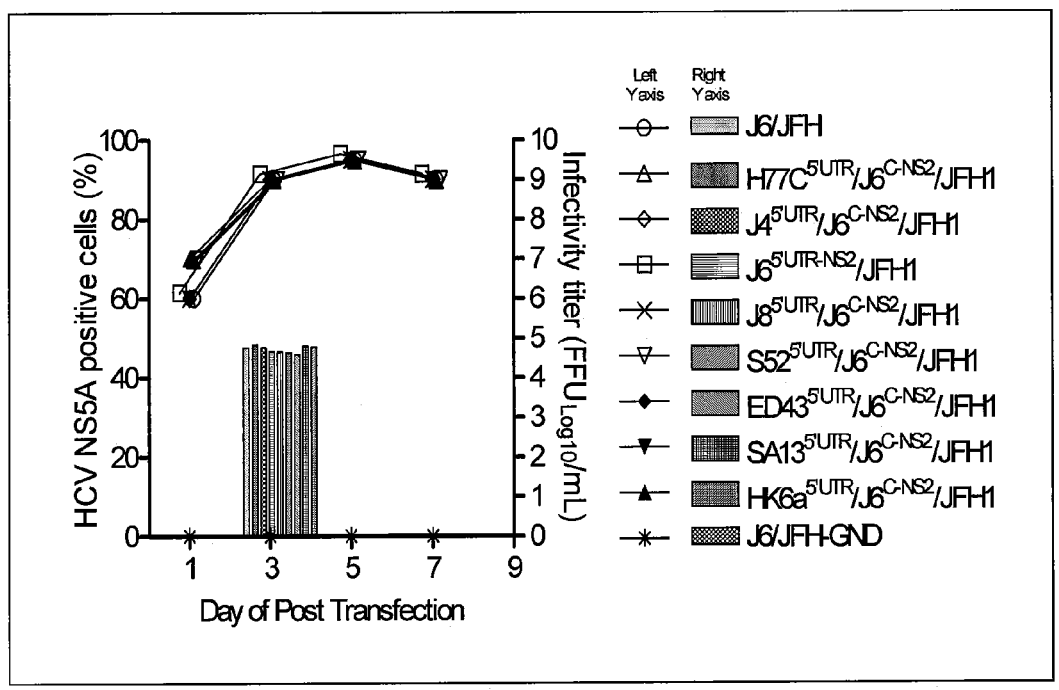
Figure 21:
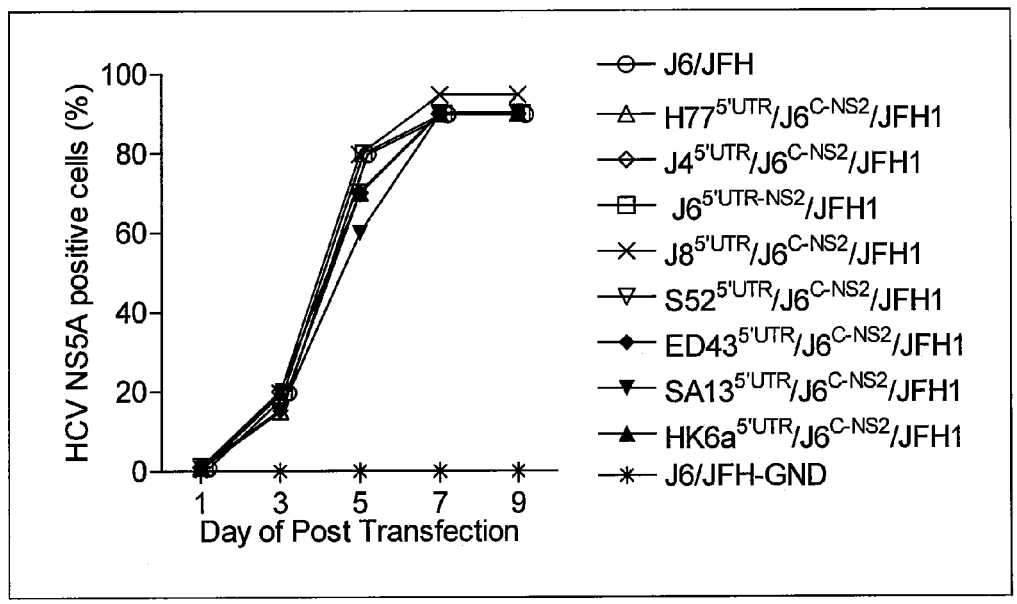

To further study the 5'UTR in an identical genetic background, we replaced the JFH 5'UTR of J6/JFH also with the 5'UTR of genotypes 1b (J4), 2b (J8), 4a (ED43), 5a (SA13) and 6a (HK6a). Together with previously developed J6/JFH1 recombinants containing 5'UTR of genotypes 1a (H77), 2a (J6) and 3a (S52), we have completed a panel of J6/JFH1 recombinants with 5'UTR of genotype 1-6. Thus, this panel of viruses contains genotype specific 5'UTR of genotype 1-6, Core-NS2 of J6, and NS3-3'UTR of JFH1. The only difference in these constructs is the genotype specific 5'UTR. Therefore, this virus panel is especially suited to study the function and biological characteristics of the 5'UTR in a genotype specific manner. E.g. the 5'UTR has been suggested to contribute to differential responses of different HCV genotypes to interferon-alfa. These viruses will ideal tools to test such a hypothesis. The RNA transcripts of these recombinants are able to efficiently produce infectious virus particles in Huh7.5 cells and produced viruses are able to efficiently infect naïve Huh7.5 cells. The viruses showed high infectivity titers and were thus—regarding spread kinetics, infectivity titers and RNA titers—comparable to J6/JFH1 (FIGS. 20 and 21). Sequencing of the 5'UTR showed that nucleotide residue A was required at position 1 of the 5'UTR (Table 5).

The present invention allows further functional study of the 5'UTR and analysis of the importance of genotype-specific sequences in the 5' UTR in the context of a complete viral lifecycle in the cell culture system. The invented viruses permit the testing of drugs targeting any steps of the replication and translation of HCV, genotype specifically or universally. Thus, the invention has great potential for future drug development and therapeutic purposes.

The viral constructs described in the present study of the 5'UTR and analysis of the importance of genotype-specific sequences in the 5' UTR also comprise cell culture adapted mutations previously reported. These adaptive mutations allow efficient formation and release of viral particles in cell culture, and thus the present invention relates to these adaptive mutations in the present use as well as use in other strains by changing equivalent positions of such genomes to the adapted nucleotide or amino acid described. For most of these systems alternative sets of adaptive mutations could be used for efficient growth, as it has been demonstrated (Gottwein et al. 2007, Scheel et al. 2008, Jensen et al. 2008 and Gottwein et al. 2009).

Thus, in another embodiment, the JFH1-based Core-NS2 recombinants of genotype 1a, 1b, 3a, 4a, 5a, 6a and 7a used as backbone for the 5' UTR construct harbour different adaptive mutations than the ones given here (see examples in Table 2). In one embodiment the recombinants comprises a G1A mutation.

The nucleotide sequences for 5'UTR recombinants are SEQ ID NOs: 21, 22, 23, 24, 25, 26, 27, 28, 37, 38, 39, 40, 41, 42, 43, 44, 45, 46, 47, 48, 49, 50, 51, 52, 109, 110, 111, 112, and 113. The amino acid sequences for theses 5'UTR recombinants are SEQ ID NOs: 29, 30, 31, 32, 33, 34, 35, 36, 53, 54, 55, 56, 57, 58, 59, 60, 61, 62, 63, 64, 65, 66, 67, 68, 114, 115, 116, 117, and 118.

An embodiment of the present invention relates the nucleic acid sequences for 5'UTR recombinants according to SEQ ID NO: 21 or SEQ ID NO: 22 or SEQ ID NO: 23 or SEQ ID NO: 24 or SEQ ID NO: 25 or SEQ ID NO: 26 or SEQ ID NO: 27 or SEQ ID NO: 28, or SEQ ID NO: 37, or SEQ ID NO: 38, or SEQ ID NO: 39, or SEQ ID NO: 40, or SEQ ID NO: 41, or SEQ ID NO: 42, or SEQ ID NO: 43, or SEQ ID NO: 44 or SEQ ID NO: 45, or SEQ ID NO: 46, or SEQ ID NO: 47, or SEQ ID NO: 48, or SEQ ID NO: 49, or SEQ ID NO: 50, or SEQ ID NO: 51 or SEQ ID NO: 52 or SEQ ID NO: 109 or SEQ ID NO: 110 or SEQ ID NO: 111 or SEQ ID NO: 112 or SEQ ID NO: 113, or a nucleic acid sequence sharing at least 90% identity with that set forth in SEQ ID NO: 21 or SEQ ID NO: 22 or SEQ ID NO: 23 or SEQ ID NO: 24 or SEQ ID NO: 25 or SEQ ID NO: 26 or SEQ ID NO: 27 or SEQ ID NO: 28, or SEQ ID NO: 37, or SEQ ID NO: 38, or SEQ ID NO: 39, or SEQ ID NO: 40, or SEQ ID NO: 41 or SEQ ID NO: 42, or SEQ ID NO: 43, or SEQ ID NO: 44 or SEQ ID NO: 45, or SEQ ID NO: 46, or SEQ ID NO: 47, or SEQ ID NO: 48, or SEQ ID NO: 49, or SEQ ID NO: 50, or SEQ ID NO: 51 or SEQ ID NO: 52 or SEQ ID NO: 109 or SEQ ID NO: 110 or SEQ ID NO: 111 or SEQ ID NO: 112 or SEQ ID NO: 113, such as 90% identity, 91% identity, 92% identity, 93% identity, 94% identity, 95% identity, 96% identity, 97% identity, 98% identity, or 99% identity.

In one embodiment the present invention relates to an isolated nucleic acid molecule, which encodes the nucleic acid sequence selected from the group consisting of SEQ ID NOs: 21, 22, 23, 24, 25, 26, 27, 28, 37, 38, 39, 40, 41, 42, 43, 44, 45, 46, 47, 48, 49, 50, 51, 52, 109, 110, 111, 112 and 113.

Thus, in one embodiment the present invention pertains to an isolated nucleic acid molecule, which encodes human hepatitis C virus of a strain selected from the group consisting of: H77$^{5'UTR-NS2}$/JFH1$_{T2701C,A4081T}$ (1a/2a), J4$^{5'UTR-NS2}$/JFH1$_{T2997C,A4828T}$ (1b/2a), J6$^{5'UTR-NS2}$/JFH1 (2a/2a), J8$^{5'UTR-NS2}$/JFH1 (2b/2a), S52$^{5'UTR-NS2}$/JFH1$_{T2717G, A4549C}$ (3a/2a), ED43$^{5'UTR-NS2}$/JFH1$_{A2819G,A3269T}$ (4a/2a), SA13$^{5'UTR-NS2}$/JFH1$_{C3404G,A3695G}$ (5a/2a) and HK6a$^{5'UTR-NS2}$/JFH1$_{T1391C,A1592C}$ (6a/2a), wherein H77$^{5'UTR-NS2}$/JFH1$_{T2701C,A4081T}$ (1a/2a) encodes the nucleic acid sequence with a sequence identity of at least 90% to that of SEQ ID NO: 21, wherein J4$^{5'UTR-NS2}$/JFH1$_{T2997C,A4828T}$ (1b/2a) encodes the nucleic acid sequence with a sequence identity of at least 90% to that of SEQ ID NO: 22, wherein J6$^{5'UTR-NS2}$/JFH1 (2a/2a) encodes the nucleic acid sequence with a sequence identity of at least 90% to that of SEQ ID NO: 23, wherein J8$^{5'UTR-NS2}$/JFH1 (2b/2a) encodes the nucleic acid sequence with a sequence identity of at least 90% to that of SEQ ID NO: 24, wherein S52$^{5'UTR-NS2}$/JFH1$_{T2717G, A4549C}$ (3a/2a) encodes the nucleic acid sequence with a sequence identity of at least 90% to that of SEQ ID NO: 25, wherein ED43$^{5'UTR-NS2}$/JFH1$_{A2819G,A3269T}$ (4a/2a) encodes the nucleic acid sequence with a sequence identity of at least 90% to that of SEQ ID NO: 26, wherein SA13$^{5'UTR-NS2}$/JFH1$_{C3404G,A3695G}$ (5a/2a) encodes the nucleic acid sequence with a sequence identity of at least 90% to that of SEQ ID NO: 27, wherein HK6a$^{5'UTR-NS2}$/JFH1$_{T1391C,A1592C}$ (6a/2a) encodes the nucleic acid sequence with a sequence identity of at least 90% to that of SEQ ID NO: 28.

An embodiment of the present invention relates the amino acid sequences for 5'UTR recombinants according to SEQ ID NO: 29 or SEQ ID NO: 30 or SEQ ID NO: 31 or SEQ ID NO: 32 or SEQ ID NO: 33 or SEQ ID NO: 34 or SEQ ID NO: 35 or SEQ ID NO: 36, or SEQ ID NO: 53, or SEQ ID NO: 54, or SEQ ID NO: 55, or SEQ ID NO: 56, or SEQ ID NO: 57, or SEQ ID NO: 58, or SEQ ID NO: 59, or SEQ ID NO: 60 or SEQ ID NO: 61, or SEQ ID NO: 62, or SEQ ID NO: 63, or SEQ ID NO: 64, or SEQ ID NO: 65 or SEQ ID NO: 66 or SEQ ID NO: 67 or SEQ ID NO: 68 or SEQ ID NO: 114, or SEQ ID NO: 115, or SEQ ID NO: 116 or SEQ ID NO: 117 or SEQ ID NO: 118, or an amino acid sequence sharing at least 90% identity with that set forth in SEQ ID NO: 29 or SEQ ID NO: 30 or SEQ ID NO: 31 or SEQ ID NO: 32 or SEQ ID NO: 33 or SEQ ID NO: 34 or SEQ ID NO: 35 or SEQ ID NO: 36, or SEQ ID NO: 53, or SEQ ID NO: 54, or SEQ ID NO: 55, or SEQ ID NO: 56, or SEQ ID NO: 57, or SEQ ID NO: 58, or SEQ ID NO: 59, or SEQ ID NO: 60 or SEQ ID NO: 61, or SEQ ID NO: 62, or SEQ ID NO: 63, or SEQ ID NO: 64, or SEQ ID NO: 65 or SEQ ID NO: 66 or SEQ ID NO: 67 or SEQ ID NO: 68 or SEQ ID NO: 114, or SEQ ID NO: 115, or SEQ ID NO: 116 or SEQ ID NO: 117 or SEQ ID NO: 118, such as 90% identity, 91% identity, 92 identity, 93% identity, 94% identity, 95% identity, 96% identity, 97 identity, 98% identity, or 99% identity.

In one embodiment the present invention relates to an isolated nucleic acid molecule, which encodes the amino acid sequence selected from the group consisting of SEQ ID NOs: 29, 30, 31, 32, 33, 34, 35, 36, 53, 54, 55, 56, 57, 58, 59, 60, 61, 62, 63, 64, 65, 66, 67, 68, 114, 115, 116, 117, and 118.

Thus, in one embodiment the present invention pertains to an isolated nucleic acid molecule, which encodes human hepatitis C virus of a strain selected from the group consisting of: H77$^{5'UTR-NS2}$/JFH1$_{T2701C,A4081T}$ (1a/2a), J4$^{5'UTR-NS2}$/JFH1$_{T2997C,A4828T}$ (1b/2a), J6$^{5'UTR-NS2}$/JFH1 (2a/2a), J8$^{5'UTR-NS2}$/JFH1 (2b/2a), S52$^{5'UTR-NS2}$/JFH1$_{T2717G, A4549C}$ (3a/2a), ED43$^{5'UTR-NS2}$/JFH1$_{A2819G,A3269T}$ (4a/2a), SA13$^{5'UTR-NS2}$/JFH1$_{C3404G,A3695G}$ (5a/2a) and HK6a$^{5'UTR-NS2}$/JFH1$_{T1391C,A1592C}$ (6a/2a), wherein H77$^{5'UTR-NS2}$/JFH1$_{T2701C,A4081T}$ (1a/2a) encodes the amino acid sequence with a sequence identity of at least 90% to that of SEQ ID NO: 29,
wherein J4$^{5'UTR-NS2}$/JFH1$_{T2997C,A4828T}$ (1b/2a) encodes the amino acid sequence with a sequence identity of at least 90% to that of SEQ ID NO: 30,
wherein J6$^{5'UTR-NS2}$/JFH1 (2a/2a) encodes the amino acid sequence with a sequence identity of at least 90% to that of SEQ ID NO: 31,
wherein J8$^{5'UTR-NS2}$/JFH1 (2b/2a) encodes the amino acid sequence with a sequence identity of at least 90% to that of SEQ ID NO: 32,
wherein S52$^{5'UTR-NS2}$/JFH1$_{T2717G,\ A4549C}$ (3a/2a) encodes the amino acid sequence with a sequence identity of at least 90% to that of SEQ ID NO: 33,
wherein ED43$^{5'UTR-NS2}$/JFH1$_{A2819G,A3269T}$ (4a/2a) encodes the amino acid sequence with a sequence identity of at least 90% to that of SEQ ID NO: 34,
wherein SA13$^{5'UTR-NS2}$/JFH1$_{C3404G,A3695G}$ (5a/2a) encodes the amino acid sequence with a sequence identity of at least 90% to that of SEQ ID NO: 35,
wherein HK6a$^{5'UTR-NS2}$/JFH1$_{T1391C,A1592C}$ (6a/2a) encodes the amino acid sequence with a sequence identity of at least 90% to that of SEQ ID NO: 36.

Naturally the embodiments described for the other reporter constructs apply to the 5'UTR and 3'UTR constructs.

Adaptive Mutations

Adapted mutants of a HCV-cDNA construct or HCV-RNA full-length genome with improved abilities to generate infectious viral particles in cell culture compared to the original HCV-cDNA construct or the original HCV-RNA full-length genome are characterized in that they are obtainable by a method in which the type and number of mutations in a cell culture adapted HCV-RNA genome are determined through sequence analysis and sequence comparison and these mutations are introduced into a HCV-cDNA construct, particularly a HCV-cDNA construct according to the present invention, or into an (isolated) HCV-RNA full-length genome, either by site-directed mutagenesis, or by exchange of DNA fragments containing the relevant mutations.

The viral constructs described in the present invention here are cell culture adapted by adaptive mutations previously reported. These adaptive mutations allow efficient formation and release of viral particles in cell culture, and thus the present invention relates to these adaptive mutations in the present use as well as use in other strains by changing equivalent positions of such genomes to the adapted nucleotide or amino acid described.

The present inventors show, that insertion of EGFP into NS5A of J6/JFH1 and JFH1-based recombinants with Core-NS2 of strain H77 (1a), TN (1a), J4 (1b), J8 (2b), S52 (3a), ED43 (4a), SA13 (5a), HK6a (6a), and QC69 (7a) required a deletion as adaptation, however, no further adaptive mutations. The present inventors also show, that insertion of mCherry, DSRed Express2, and hRLuc in J6/JFH1 required a deletion as adaptation, however, no further adaptive mutations.

In an embodiment, the isolated nucleic acid molecule provided by the present invention comprises one or more adaptive mutations in Core, E1, E2, p7, NS2, NS3, NS4A, NS4B, NS5A or NS5B singly or in combination.

Another embodiment the present invention relates to an isolated nucleic acid molecule of the invention, wherein said adaptive mutation is at least one of the replacements of the first said nucleotide at the said position of SEQ ID NO: 1 or SEQ ID NO: 121 by the following said nucleotide selected from the group consisting of T2700C, A4080T and C4562T.

Another embodiment the present invention relates to an isolated nucleic acid molecule of the invention, wherein said adaptive mutation is at least one of the replacements of the first said nucleotide at the said position of SEQ ID NO: 119 or SEQ ID NO: 122 by the following said nucleotide selected from the group consisting of T2700C, A4080T, C4562T, G4631A and A5436G.

Another embodiment the invention relates to an isolated nucleic acid molecule of the invention, wherein said adaptive mutation is at least one of the replacements of the first said nucleotide at the said position of SEQ ID NO: 2 or SEQ ID NO: 123 by the following said nucleotide selected from the group consisting of T2996C, T2996G, T2996A, A4274G, A4532C, C4562T and A4827T.

Another embodiment the invention relates to an isolated nucleic acid molecule of the invention, wherein said adaptive mutation is at least one of the replacements of the first said nucleotide at the said position of SEQ ID NO: 5 or SEQ ID NO: 124 by the following said nucleotide selected from the group consisting of T2718G, T2718C, A2721G, A4550C, A4845T and T7160C.

Another embodiment the invention relates to an isolated nucleic acid molecule of the invention, wherein said adaptive mutation is at least one of the replacements of the first said nucleotide at the said position of SEQ ID NO: 6 or SEQ ID NO: 125 by the following said nucleotide selected from the group consisting of A2819G and A3269T.

Another embodiment the invention relates to an isolated nucleic acid molecule of the invention, wherein said adaptive mutation is at least one of the replacements of the first said nucleotide at the said position of SEQ ID NO: 7 or SEQ ID NO: 126 by the following said nucleotide selected from the group consisting of C3068G, C3405G, A3696G, A4083T and A4277G.

Another embodiment the invention relates to an isolated nucleic acid molecule of the invention, wherein said adaptive mutation is at least one of the replacements of the first said nucleotide at the said position of SEQ ID NO: 8 or SEQ ID NO: 127 by the following said nucleotide selected from the group consisting of T1389C and A1590C.

Another embodiment the invention relates to an isolated nucleic acid molecule of the invention, wherein said adaptive mutation is at least one of the replacements of the first said nucleotide at the said position of SEQ ID NO: 9 by the following said nucleotide selected from the group consisting of G809T, T1581C, T2985C and C9018T.

Another embodiment the invention relates to an isolated nucleic acid molecule of the invention, wherein said adaptive mutation is at least one of the replacements of the first said nucleotide at the said position of SEQ ID 128 by the following said nucleotide selected from the group consisting of G809T, T1581C, T2985C and C9234T.

Another embodiment the invention relates to an isolated nucleic acid molecule of the invention encoding an amino acid, wherein said adaptive mutation is at least one of the replacements of the first said amino acid at the said position of SEQ ID NO: 11 or SEQ ID NO: 121 by the following said amino acid selected from the group consisting of V787A, Q1247L and R1408W.

Another embodiment the invention relates to an isolated nucleic acid molecule of the invention encoding an amino acid, wherein said adaptive mutation is at least one of the replacements of the first said amino acid at the said position of SEQ ID NO: 120 or SEQ ID NO: 122 by the following said amino acid selected from the group consisting of V787A, Q1247L, R1408W, D1431N, and E1699G.

Another embodiment the invention relates to an isolated nucleic acid molecule of the invention encoding an amino acid, wherein said adaptive mutation is at least one of the replacements of the first said amino acid at the said position of SEQ ID NO: 12 or SEQ ID NO: 131 by the following said amino acid selected from the group consisting of F886L, F886V, F886I, I1312V, K1398Q, R1408W and Q1496L.

Another embodiment the invention relates to an isolated nucleic acid molecule of the invention encoding an amino acid, wherein said adaptive mutation is at least one of the replacements of the first said amino acid at the said position of SEQ ID NO: 15 or SEQ ID NO: 132 by the following said amino acid selected from the group consisting of I793S, I793T, Y794C, K1404Q, Q1502L and S2274P.

Another embodiment the invention relates to an isolated nucleic acid molecule of the invention encoding an amino acid, wherein said adaptive mutation is at least one of the replacements of the first said amino acid at the said position of SEQ ID NO: 16 or SEQ ID NO: 133 by the following said amino acid selected from the group consisting of T827A and T977S.

Another embodiment the invention relates to an isolated nucleic acid molecule of the invention encoding an amino acid, wherein said adaptive mutation is at least one of the replacements of the first said amino acid at the said position of SEQ ID NO: 17 or SEQ ID NO: 134 by the following said amino acid selected from the group consisting of L910V, A1022G, K1119R, Q1248L and I1313V.

Another embodiment the invention relates to an isolated nucleic acid molecule of the invention encoding an amino acid, wherein said adaptive mutation is at least one of the replacements of the first said amino acid at the said position of SEQ ID NO: 18 or SEQ ID NO: 135 by the following said amino acid selected from the group consisting of F350S and N417T.

Another embodiment the invention relates to an isolated nucleic acid molecule of the invention encoding an amino acid, wherein said adaptive mutation is at least one of the replacements of the first said amino acid at the said position of SEQ ID NO: 19 by the following said amino acid selected from the group consisting of V157F, I414T, L882P and A2893V.

Another embodiment the invention relates to an isolated nucleic acid molecule of the invention encoding an amino acid, wherein said adaptive mutation is at least one of the replacements of the first said amino acid at the said position of SEQ ID NO: 136 by the following said amino acid selected from the group consisting of V157F, I414T, L882P and A2965V.

All given examples of which adaptive mutations can be used to adapt a given sequence have to be considered as examples. These examples include the adaptive mutations originally identified for a JFH1-based recombinant with a given genotype of Core-NS2. Additional studies have shown, that several mutations identified in a recombinant of one given Core-NS2 genotype can also adapt a recombinant of another given Core-NS2 genotype. However, not all Core-NS2 recombinants can be adapted with the same mutations.

Another embodiment relates to a nucleic acid molecule of the invention, wherein said nucleic acid molecule comprises further adaptive mutations acquired during transfection and/or subsequent viral passage.

A further embodiment relates to an amino acid molecule of the invention, wherein said amino acid molecule comprises further adaptive mutations acquired during transfection and/or subsequent viral passage.

Titer

One embodiment of the present invention relates to an isolated nucleic acid molecule of the present invention, wherein said molecule is capable of generating a HCV RNA titer not represented by input of said molecule itself of $10^4$ IU/ml or above following transfection and/or subsequent viral passage, such as a titer of at least $10^5$ IU/mL, such as a titer of at least $10^6$ IU/mL, such as a titer of at least $10^7$ IU/mL, such as a titer of at least $10^8$ IU/mL, such as a titer of at least $10^9$ IU/mL, such as a titer of at least $10^{10}$ IU/mL, such as a titer of at least $10^{11}$ IU/mL, or such as a titer of at least $10^{12}$ IU/mL.

In another embodiment, the present invention relates to an isolated nucleic acid molecule according to the invention, wherein said molecule is capable of generating a HCV infectivity titer of $10^2$ TCID$_{50}$/ml (50% tissue culture infectious doses)/ml or above following transfection and/or subsequent viral passage, such as a titer of at least $10^3$ TCID$_{50}$/ml, such as a titer of at least $10^4$ TCID$_{50}$/ml, such as a titer of at least $10^5$ TCID$_{50}$/ml, such as a titer of at least $10^6$ TCID$_{50}$/ml, such as a titer of at least $10^7$ TCID$_{50}$/ml, such as a titer of at least $10^8$ TCID$_{50}$/ml, such as a titer of at least $10^9$ TCID$_{50}$/ml or such as a titer of at least $10^{10}$ TCID$_{50}$/ml.

It is of course evident to the skilled addressee that the titers described here is obtained using the assay described in this text. Any similar or equivalent titer determined by any method is thus evidently within the scope of the present invention.

Compositions

One embodiment of the present invention relates to a composition comprising a nucleic acid molecule according to the invention suspended in a suitable amount of a pharmaceutical acceptable diluent or excipient.

In another embodiment, this invention provides for compositions comprising an isolated nucleic acid, vector or cell of this invention, or an isolated nucleic acid obtained via the methods of this invention.

In one embodiment, the term "composition" refers to any such composition suitable for administration to a subject, and such compositions may comprise a pharmaceutically acceptable carrier or diluent, for any of the indications or modes of administration as described. The active materials in the compositions of this invention can be administered by any appropriate route, for example, orally, parenterally, intravenously, intradermally, subcutaneously, or topically, in liquid or solid form.

It is to be understood that any applicable drug delivery system may be used with the compositions and/or agents/vectors/cells/nucleic acids of this invention, for administration to a subject, and is to be considered as part of this invention.

The compositions of the invention can be administered as conventional HCV therapeutics. The compositions of the invention may include more than one active ingredient which interrupts or otherwise alters groove formation, or occupancy by RNA or other cellular host factors, in one embodiment, or replicase components, in another embodiment, or zinc incorporation, in another embodiment.

The precise formulations and modes of administration of the compositions of the invention will depend on the nature of the anti-HCV agent, the condition of the subject, and the judgment of the practitioner. Design of such administration and formulation is routine optimization generally carried out without difficulty by the practitioner.

It is to be understood that any of the methods of this invention, whereby a nucleic acid, vector or cell of this invention is used, may also employ a composition comprising the same as herein described, and is to be considered as part of this invention.

"Pharmaceutically acceptable" refers to molecular entities and compositions that are physiologically tolerable and do not typically produce an allergic or similar untoward reaction, such as gastric upset, dizziness and the like, when administered to a human. Preferably, as used herein, the term "pharmaceutically acceptable" means approved by a regulatory agency of the Federal or a state government or listed in the U.S. Pharmacopoeia or other generally recognized pharmacopoeia for use in animals, and more particularly in humans.

The term "excipient" refers to a diluent, adjuvant, carrier, or vehicle with which the compound is administered. Such pharmaceutical carriers can be sterile liquids, such as water and oils, including those of petroleum, animal, vegetable or synthetic origin, such as peanut oil, soybean oil, mineral oil, sesame oil and the like. Water or aqueous solution saline solutions and aqueous dextrose and glycerol solutions are preferably employed as carriers, particularly for injectable solutions. Suitable pharmaceutical carriers are described in "Remington's Pharmaceutical Sciences" by E. W. Martin.

The term "adjuvant" refers to a compound or mixture that enhances the immune response to an antigen. An adjuvant can serve as a tissue depot that slowly releases the antigen and also as a lymphoid system activator that non-specifically enhances the immune response. Often, a primary challenge with an antigen alone, in the absence of an adjuvant, will fail to elicit a humoral or cellular immune response. Adjuvants include, but are not limited to, complete Freund's adjuvant, incomplete Freund's adjuvant, saponin, mineral gels such as aluminum hydroxide, surface active substances such as lysolecithin, pluronic polyols, polyanions, peptides, oil or hydrocarbon emulsions, keyhole limpet hemocyanins, dinitrophenol, and potentially useful human adjuvants such as BCG (bacille Calmette-Guerin) and *Corynebacterium parvum*. Preferably, the adjuvant is pharmaceutically acceptable.

Cells

The nucleotides of the present invention may be used to provide a method for identifying additional cell lines that are permissive for infection with HCV, comprising contacting (e.g. transfecting) a cell line in tissue culture with an infectious amount of HCV RNA of the present invention, e.g., as produced from the plasmid clones, and detecting replication and formation and release of viral particles of HCV in cells of the cell line.

Naturally, the invention extends as well to a method for identifying an animal that is permissive for infection with HCV, comprising introducing an infectious amount of the HCV RNA, e.g., as produced by the plasmids, to the animal, and detecting replication and formation and release of viral particles of HCV in the animal. By providing infectious HCV, e.g. comprising a dominant selectable marker, the invention further provides a method for selecting for HCV with further adaptive mutations that permit higher levels of HCV replication in a permissive cell line or animal comprising contacting (e.g. transfecting) a cell line in culture, or introducing into an animal, an infectious amount of the HCV RNA, and detecting progressively increasing levels of HCV RNA and infectious HCV viral particles in the cell line or the animal.

The permissive cell lines or animals that are identified using the nucleic acids of the invention are very useful, inter alia, for studying the natural history of HCV infection, isolating functional components of HCV, and for sensitive, fast diagnostic applications, in addition to producing authentic HCV virus or components thereof.

Because the HCV DNA, e.g., plasmid vectors, of the invention encode HCV components, expression of such vectors in a host cell line transfected, transformed, or transduced with the HCV DNA can be effected.

For example, a baculovirus or plant expression system can be used to express HCV virus particles or components thereof. Thus, a host cell line may be selected from the group consisting of a bacterial cell, a yeast cell, a plant cell, an insect cell, and a mammalian cell.

In one embodiment, the cell, or in another embodiment, cell systems of this invention comprise primary cultures or other, also non hepatic cell lines. "Primary cultures" refers, in one embodiment, to a culture of cells that is directly derived from cells or tissues from an individual, as well as cells derived by passage from these cells, or immortalized cells.

In one embodiment, "cell line" refers to a population of cells capable of continuous or prolonged growth and division in vitro. The term "cell lines" also includes immortalized cells. Often, cell lines are clonal populations derived from a single progenitor cell. Such cell lines are also termed "cell clones". It is further known in the art that spontaneous or induced changes can occur in karyotype during storage or transfer of such clonal populations. Therefore, cells derived from the cell clones referred to may not be precisely identical to the ancestral cells or cultures. According to the present invention, such cell clones may be capable of supporting replication of a vector, virus, viral particle, etc., of this invention, without a significant decrease in their growth properties, and are to be considered as part of this invention.

It is to be understood that any cell of any organism that is susceptible to infection by or propagation of an HCV construct, virus or viral particle of this invention is to be considered as part of this invention, and may be used in any method of this invention, such as for screening or other assays, as described herein.

Thus, one specific embodiment of the invention relates to method for producing a cell, which replicates H77/JFH1-EGFPΔ (1a/2a), TN/JFH1-EGFPΔ (1a/2a), J4/JFH1-EGFPΔ (1b/2a), J6/JFH1-EGFPΔ (2a/2a), J8/JFH1-EGFPΔ (2b/2a), S52/JFH1-EGFPΔ (3a/2a), ED43/JFH1-EGFPΔ (4a/2a), SA13/JFH1-EGFPΔ (5a/2a), HK6a/JFH1-EGFPΔ (6a/2a), QC69/JFH1-EGFPΔ (7a/2a), H77/JFH1-hRlucΔ (1a/2a); TN/JFH1-hRlucΔ (1a/2a); J4/JFH1-hRlucΔ (1b/2a); J6/JFH1-hRlucΔ (2a/2a); J8/JFH1-hRlucΔ (2b/2a); S52/JFH1-hRlucΔ (3a/2a); ED43/JFH1-hRlucΔ (4a/2a); SA13/JFH1-RlucΔ (5a/2a); HK6a/JFH1-hRlucΔ (6a/2a); QC69/JFH1-hRlucΔ (7a/2a), J6/JFH1-CherryΔ (2a/2a), or J6/JFH1-DSRedΔ (2a/2a) RNA and produces a virus particle comprising introducing a replicating RNA of the invention.

Also, a method for in vitro producing a hepatitis C virus-infected cell comprising culturing the cell which produces virus particles of the present invention and infecting other cells with the produced virus particle in the culture.

Naturally, the invention extends to any cell obtainable by such methods, for example any in vitro cell line infected with HCV, wherein the HCV has a genomic RNA sequence as described herein such as a hepatitis C virus infected cell obtainable by any of the methods described.

In one embodiment, the cell line is a hepatocyte cell line such as Huh7 or derived cell lines e.g. Huh7.5 or Huh7.5.1.

In another embodiment cell is Huh7.5.

Naturally, the invention extends to any cell obtainable by such methods, for example any in vitro cell line infected with HCV, wherein the HCV has a genomic RNA sequence as described herein. Such as a hepatitis C virus infected cell obtainable by any of the methods described.

The invention further provides various methods for producing HCV virus particles, including by isolating HCV virus particles from the HCV-infected non-human animal of invention; culturing a cell line of the invention under conditions that permit HCV replication and virus particle formation; or culturing a host expression cell line transfected with HCV DNA under conditions that permit expression of HCV particle proteins; and isolating HCV particles or particle proteins from the cell culture. The present invention extends to an HCV virus particle comprising a replication-competent HCV genome RNA, or a replication-defective HCV genome RNA, corresponding to an HCV nucleic acid of the invention as well.

A further embodiment of the invention is the cell obtainable by the method for producing a cell, which replicates HCV RNA and produces a virus particle comprising introducing a replicating RNA of the invention.

Virus Particle

The production of authentic virus proteins (antigens) may be used for the development and/or evaluation of diagnostics. The cell culture system according to the invention also allows the expression of HCV antigens in cell cultures. In principle these antigens can be used as the basis for diagnostic detection methods.

The production of HCV viruses and virus-like particles, and in particular for the development or production of therapeutics and vaccines as well as for diagnostic purposes is an embodiment of the present invention. Especially cell culture adapted complete HCV genomes, which could be produced by using the cell culture system according to the invention, are able to replicate and form viral particles in cell culture with high efficiency. These genomes have the complete functions of HCV and in consequence they are able to produce infectious viruses.

Thus, in one embodiment the present invention relates to a method for producing a hepatitis C virus particle, comprising culturing the cell which replicates HCV RNA and produces a virus particle of the invention to allow the cell to produce the virus.

Another embodiment of the invention is the hepatitis C virus particle obtainable by the method described.

Because the invention provides, inter alia, infectious HCV RNA, the invention provides a method for infecting an animal with HCV, which comprises administering an infectious dose of HCV RNA, such as the HCV RNA transcribed from the plasmids described above, to the animal. Naturally, the invention provides a non-human animal infected with HCV of the invention, which non-human animal can be prepared by the foregoing methods.

A further advantage of the present invention is that, by providing a complete functional HCV genome, authentic HCV viral particles or components thereof, which may be produced with native HCV proteins or RNA in a way that is not possible in subunit expression systems, can be prepared.

In addition, since each component of HCV of the invention is functional (thus yielding the authentic HCV), any specific HCV component is an authentic component, i.e., lacking any errors that may, at least in part, affect the clones of the prior art. Indeed, a further advantage of the invention is the ability to generate HCV virus particles or virus particle proteins that are structurally identical to or closely related to natural HCV virions or proteins.

Thus, in a further embodiment, the invention provides a method for propagating HCV in vitro comprising culturing a cell line contacted with an infectious amount of HCV RNA of the invention, e.g., HCV RNA translated from the plasmids described above, under conditions that permit replication of the HCV RNA.

Yet another embodiment of the invention relates to a hepatitis C virus infected cell obtainable by the method described.

Further the viability of the developed viruses may be determined in vivo, either in SCID-uPA mice engrafted with human liver tissue or in chimpanzees as shown in Lindenbach et al. 2006.

In one embodiment, the method further comprises isolating infectious HCV. In another embodiment, the method further comprises freezing aliquots of said infectious HCV. According to this aspect of the invention, and in one embodiment, the HCV is infectious following thawing of said aliquots, and in another embodiment, the HCV is infectious following repeated freeze-thaw cycles of said aliquots.

Screening for Anti-Viral Drugs and the Determination of Drug Resistance

It can be assumed that resistance to therapy occurs due to the high mutation rate of the HCV genome. This resistance, which is very important for the clinical approval of a substance, can be detected with the cell culture system according to the invention. Cell lines, in which the HCV-RNA construct or the HCV genome or subgenome replicates and produces infectious viral particles, are incubated with increasing concentrations of the relevant substance and the replication of the viral RNA is either determined by means of an introduced reporter gene or through the qualitative or quantitative detection of the viral nucleic acids or proteins. The release of viral particles is determined by measuring HCV RNA and infectivity titers in the cell culture supernatant. Resistance is given if no or a reduced inhibition of the replication and release of viral particles can be observed with the normal concentration of the active substance. The nucleotide and amino acid replacements responsible for the therapy resistance can be determined by recloning the HCV-RNA (for example by the means of RT-PCR) and sequence analysis. By cloning the relevant replacement(s) into the original construct its causality for the resistance to therapy can be proven.

While the replicon systems facilitated testing of drugs interfering with replication such as NS3/4A protease and polymerase inhibitors, the variant genomes obtained in the present study will be useful for high throughput screening of viral inhibitors in context of the complete viral life cycle.

Thus, an embodiment of the invention relates to a method for screening an anti-hepatitis C virus substance, comprising
a) culturing at least one selected from the group consisting of a cell which replicates HCV RNA and produces a virus particle comprising introducing a replicating RNA of the invention, a hepatitis C virus infected cell of the invention and a hepatitis C virus particle of the invention together with a hepatitis C virus permissive cell, and
b) detecting the replicating RNA or the virus particles in the resulting culture.

Thus, one embodiment of the present invention relates to a method for screening an anti-hepatitis C virus substance, comprising
a) culturing at least one selected from the group consisting of a cell according to the present invention, a hepatitis C virus infected cell according to the present invention and a hepatitis C virus particle obtainable by the present invention together with a hepatitis C virus permissive cell, and
b) subjecting said virus or virus infected cell culture to the anti-hepatitis C virus substance, and
c) detecting the replicating RNA and/or the virus particles in the resulting culture.

The invention further provides a method for assaying candidate antiviral agents for activity against HCV, comprising:
a) exposing a cell containing the hepatitis C virus to the candidate antiviral agent; and b) measuring the presence or absence of hepatitis C virus replication in the cell of step (a).

The replication in step (b) may be measured by at least one of the following: negative strand RT-PCR, quantitative RT-PCR, Western blot, immunofluorescence, or infectivity in a susceptible cell culture or animal model.

The invention extends to a method for assaying candidate antiviral agents for activity against HCV, comprising: a) exposing HCV protease encoded by any of the nucleic acid sequences described previously or a fragment thereof to the candidate antiviral agent in the presence of a protease substrate; and b) measuring the protease activity of said protease.

In another embodiment, the inhibition of HCV replication and/or infection and/or pathogenesis includes inhibition of downstream effects of HCV. In one embodiment, downstream effects include neoplastic disease, including, in one embodiment, the development of hepatocellular carcinoma.

Thus, a J6/JFH1-EGFP reporter virus, with an identified deletion in NS5A that led to spread kinetics and infectivity titers comparable to those of J6/JFH reference virus, has been developed. J6/JFH1-EGFPΔ was genetically stable after passage in cell culture and did not require further adaptation.

EGFP-tagged JFH1-based recombinants of genotype 1a (H77 and TN), 1b (J4), 2b (J8), 3a (S52), 4a (ED43), 5a (SA13), 6a (HK6a) and 7a (QC69) with the identified deletion in HCV NS5A have been developed. Further, hRLuc-tagged JFH1-based recombinants of genotype 1a (H77 and TN), 1b (J4), 2b (J8), 3a (S52), 4a (ED43), 5a (SA13), 6a (HK6a) and 7a (QC69) with the identified deletion in HCV NS5A have been developed. At last, J6/JFH1-CherryΔ, and J6/JFH1-DSRedΔ have been developed. All reporter viruses spread in cell culture and produced relatively high infectivity titers.

For certain applications it could be of advantage to insert different reporter genes at the described position in NS5A. Thus, for example red or yellow fluorescent protein or Firefly luciferase could be inserted. We have generated viruses with green (EGFP) and red (mCherry and DSRed Express2) fluorescent reporter genes, respectively.

In vivo studies, the percentage and localization of infected liver cells could be readily monitored during the course of infection. Identification of extra hepatic sites of HCV infection has so far has been difficult to tackle but is of interest, since in patients HCV infection is associated with several extra hepatic manifestations. Utilizing green and red fluorescent protein tagged viruses; it could be studies if and at what frequency co-infection and/or superinfection of hepatocytes occurs in vivo.

Reporter activity of EGFP can be determined by confocal fluorescence microscopy. It will be of interest to set up live imaging analysis in order to monitor basic steps of the viral life cycle, e.g. to determine the interval between infection and NS5A protein expression, the redistribution of NS5A to cellular organelles and its cellular interaction partners, in single infectious cycle cell culture systems.

To enable high throughput analysis, EGFP by flow cytometry and in a fluorescence plate reader is measured. Reporter activity of luciferase is determined in a luminescence plate reader. Such assays can be used to investigate the antiviral potential of drugs and neutralizing antibodies, induced by vaccine candidates or present in HCV infected patients. Thus, these reporter viruses will contribute to development of new antivirals, vaccines and immunotherapy.

The developed systems could aid individualized treatment of HCV infected patients. Patient isolates could be tested for resistance to drugs by introduction of genome regions involved in drug resistance in the developed constructs and subsequent treatment with the drug of interest. For example, for testing of neutralizing antibody preparations, potentially used in immunotherapy, E1/E2 genome regions of patient isolates could be introduced in the developed recombinants.

For such applications, timesaving procedures, such as shuttle vector systems, could be employed. High-throughput techniques to address basic research applications, such as studies of HCV entry, in a more economical and timesaving manner is now possible.

At last, analysis of the described deletions could clarify the function of these regions in HCV NS5A.

In one embodiment, the invention provides a method of screening for anti-HCV therapeutics, the method comprising contacting a cell with an isolated nucleic acid molecule encoding an infectious recombinant HCV genome, comprising a chimeric HCV genome and contacting the cell with a candidate molecule, independently contacting the cell with a placebo and determining the effects of the candidate molecule on HCV infection, replication, or cell-to-cell spread, versus the effects of the placebo, wherein a decrease in the level of HCV infection, replication, or cell-to-cell spread indicates the candidate molecule is an anti-HCV therapeutic.

In one embodiment, the method may be conducted be in vitro or in vivo. In one embodiment, the cells as described may be in an animal model, or a human subject, entered in a clinical trial to evaluate the efficacy of a candidate molecule. In one embodiment, the molecule is labelled for easier detection, including radio-labelled, antibody labelled for fluorescently labelled molecules, which may be detected by any means well known to one skilled in the art.

In one embodiment, the candidate molecule is an antibody.

In one embodiment, the term "antibody" refers to intact molecules as well as functional fragments thereof, such as Fab, F(ab')2, and Fv. In one embodiment, the term "Fab" refers to a fragment, which contains a monovalent antigen-binding fragment of an antibody molecule, and in one embodiment, can be produced by digestion of whole antibody with the enzyme papain to yield an intact light chain and a portion of one heavy chain, or in another embodiment can be obtained by treating whole antibody with pepsin, followed by reduction, to yield an intact light chain and a portion of the heavy chain. In one embodiment, the term "F(ab')2", refers to the fragment of the antibody that can be obtained by treating whole antibody with the enzyme pepsin without subsequent reduction, F(ab')2 is a dimer of two Fab' fragments held together by two disulfide bonds. In another embodiment, the term "Fv" refers to a genetically engineered fragment containing the variable region of the light chain and the variable region of the heavy chain expressed as two chains, and in another embodiment, the term "single chain antibody" or "SCA" refers to a genetically engineered molecule containing the variable region of the light chain and the variable region of the heavy chain, linked by a suitable polypeptide linker as a genetically fused single chain molecule.

Methods of producing these fragments are known in the art.

In another embodiment, the candidate molecule is a small molecule. In one embodiment, the phrase "small molecule" refers to, inter-alia, synthetic organic structures typical of pharmaceuticals, peptides, nucleic acids, peptide nucleic acids, carbohydrates, lipids, and others, as will be appreciated by one skilled in the art. In another embodiment, small molecules, may refer to chemically synthesized peptidomimetics of the 6-mer to 9-mer peptides of the invention.

In another embodiment, the candidate molecule is a nucleic acid. Numerous nucleic acid molecules can be envisioned for use in such applications, including antisense, siRNA, ribozymes, etc., as will be appreciated by one skilled in the art.

It is to be understood that the candidate molecule identified and/or evaluated by the methods of this invention, may be any compound, including, inter-alia, a crystal, protein, peptide or nucleic acid, and may comprise an HCV viral product or derivative thereof, of a cellular product or derivative thereof. The candidate molecule in other embodiments may be isolated, generated synthetically, obtained via translation of sequences subjected to any mutagenesis technique, or obtained via protein evolution techniques, well known to those skilled in the art, each of which represents an embodiment of this invention, and may be used in the methods of this invention, as well.

In one embodiment, the compound identified in the screening methods as described, may be identified by computer modeling techniques, and others, as described herein. Verification of the activity of these compounds may be accomplished by the methods described herein, where, in one embodiment, the test compound demonstrably affects HCV infection, replication and/or pathogenesis in an assay, as described. In one embodiment, the assay is a cell-based assay, which, in one embodiment, makes use of primary isolates, or in another embodiment, cell lines, etc. In one embodiment, the cell is within a homogenate, or in another embodiment, a tissue slice, or in another embodiment, an organ culture. In one embodiment, the cell or tissue is hepatic in origin, or is a derivative thereof. In another embodiment, the cell is a commonly used mammalian cell line, which has been engineered to express key molecules known to be, or in another embodiment, thought to be involved in HCV infection, replication and/or pathogenesis.

In another embodiment, protein, or in another embodiment, peptide or in another embodiment, other inhibitors of the present invention cause inhibition of infection, replication, or pathogenesis of HCV in vitro or, in another embodiment, in vivo when introduced into a host cell containing the virus, and may exhibit, in another embodiment, an IC50 in the range of from about 0.0001 nM to 100 µM in an in vitro assay for at least one step in infection, replication, or pathogenesis of HCV, more preferably from about 0.0001 nM to 75 µM, more preferably from about 0.0001 nM to 50 µM, more preferably from about 0.0001 nM to 25 µM, more preferably from about 0.0001 nM to 10 µM, and even more preferably from about 0.0001 nM to 1 µM.

In another embodiment, the inhibitors of HCV infection, or in another embodiment, replication, or in another embodiment, pathogenesis, may be used, in another embodiment, in ex vivo scenarios, such as, for example, in routine treatment of blood products wherein a possibility of HCV infection exists, when serology shows a lack of HCV infection.

In another embodiment, the anti-HCV therapeutic compounds identified via any of the methods of the present invention can be further characterized using secondary screens in cell cultures and/or susceptible animal models. In one embodiment, a small animal model may be used, such as, for example, a tree shrew *Tupaia belangeri chinensis*. In another embodiment, an animal model may make use of a chimpanzee. Test animals may be treated with the candidate compounds that produced the strongest inhibitory effects in any of the assays/methods of this invention. In another embodiment, the animal models provide a platform for pharmacokinetic and toxicology studies.

Kits

In a related aspect, the invention also provides a test kit for HCV comprising HCV virus components, and a diagnostic test kit for HCV comprising components derived from an HCV virus as described herein.

Furthermore the invention also provide test kits, for screening for new HCV genotype 1a/1b, 2a, 3a, 4a, 5a and 6a inhibitors, neutralizing and cross neutralizing antibodies, comprising HCV virus components.

Vaccines

The construct according to the invention by itself can also be used for various purposes in all its embodiments. This includes the construction of hepatitis C viruses or HCV-like particles and their production in cell cultures as described.

These HCV or HCV-like particles can be used in particular as vaccine. Thus, one embodiment of the present invention relates to a hepatitis C vaccine comprising a hepatitis C virus particle according to the invention or a part thereof.

In another embodiment, the nucleic acids, vectors, viruses, or viral particles may be further engineered to express a heterologous protein, which, in another embodiment, is mammalian or a derivative thereof, which is useful in combating HCV infection or disease progression. Such proteins may comprise cytokines, growth factors, tumor suppressors, or in one embodiment, may following infection, be expressed predominantly or exclusively on an infected cell surface. According to this aspect of the invention, and in one embodiment, such molecules may include costimulatory molecules, which may serve to enhance immune response to infected cells, or preneoplastic cells, or neoplastic cells, which may have become preneoplastic or neoplastic as a result of HCV infection. In one embodiment, the heterologous sequence encoded in the nucleic acids, vectors, viruses, or viral particles of this invention may be involved in enhanced uptake of a nucleic acids, vectors, viruses, or viral particles, and may specifically target receptors thought to mediate HCV infection.

Further, the present invention relates to a method for producing a hepatitis C virus vaccine comprising using a hepatitis C virus particle according to the invention as an antigen, and naturally any antibody against such hepatitis C virus particle.

Another embodiment of the invention relates to a hepatitis C vaccine comprising a hepatitis C virus particle of the invention General Reference to any prior art in this specification is not, and should not be taken as, an acknowledgment or any form of suggestion that this prior art forms part of the common general knowledge in any country.

All patent and non-patent references cited in the present application, are hereby incorporated by reference in their entirety.

As will be apparent, preferred features and characteristics of one aspect of the invention may be applicable to other aspects of the invention. The invention may be embodied in other specific forms without departing from the spirit or essential characteristics thereof. The foregoing embodiments are therefore to be considered in all respects illustrative rather than limiting on the invention described herein. Scope of the invention is thus indicated be the appended claims rather than by the foregoing description, and all changes that come within the meaning and range of equivalency of the claims are intended to be embraced by reference therein.

Throughout this specification the word "comprise", or variations such as "comprises" or "comprising", will be understood to imply the inclusion of a stated element, integer or step, or group of elements, integers or steps, but not the exclusion of any other element, integer or step, or group of elements, integers or steps.

In addition, singular reference does not exclude a plurality. Thus, references to "a", "an", "first", "second" etc. do not preclude a plurality.

The invention may be embodied in other specific forms without departing from the spirit or essential characteristics thereof. The foregoing embodiments are therefore to be considered in all respects illustrative rather than limiting on the invention described herein. Scope of the invention is thus indicated be the appended claims rather than by the foregoing description, and all changes that come within the meaning and range of equivalency of the claims are intended to be embraced by reference therein.

The invention will hereinafter be described by way of the following non-limiting Figures and Examples.

EXAMPLES

Materials and Methods

Construction of Reporter Viruses pEGFP-N1, pmCherry-C1, and pDSRed Express2-C1 was from Clontech and pGL4.70[hRluc] was from Promega. pJ6/JFH1-EGFP, pJ6/JFH1-Cherry, pJ6/JFH1-DSRed, and pJ6/JFH1-hRluc were created by insertion of the EGFP/Cherry/DSRed/hRluc coding sequence in J6/JFH (gift from C. Rice, Rockefeller University) in frame immediately downstream of NS5A amino acid 418 (nucleotide 1254, both relative aa/nt numbers), relating to the J6/JFH and the H77 reference sequence (equivalent to absolute nt numbers nt 7522 and nt 7511 on the J6/JFH and H77 genome, respectively), using standard cloning techniques based on fusion PCR and restriction digests. pJ6/JFH1-EGFPΔ, pJ6/JFH1-CherryΔ, pJ6/JFH1-DSRedΔ, and pJ6/JFH1-hRlucΔ was created by deletion of nucleotides 7016-7135 (nt 7005-7136 relating to H77 reference sequence; absolute nucleotide number, relating to the entire J6/JFH1 genome; according to nt 748-867 and aa 250-289, relative nt/aa numbers relating to JFH1 NS5A protein) from pJ6/JFH1-EGFP, pJ6/JFH1-Cherry, pJ6/JFH1-DSRed, and pJ6/JFH1-hRluc, respectively, using fusion PCR and restriction digest. Plasmids of EGFPΔ- or hRLucΔ-tagged JFH1-based recombinants of the different genotypes were constructed by introduction of the EGFPΔ or hRLucΔ sequence in intragenotypic or intergenotypic recombinants with Core-NS2 of the various genotypes, of which recombinants with Core-NS2 of genotypes 1a, 1b, 3a, 4a, 5a, 6a, and 7a contained cell culture adaptive mutations. Generation of these non-tagged recombinants is described in (Lindenbach et al. 2005), (Gottwein et al. 2007), (Scheel et al. 2008), (Jensen et al. 2008), and (Gottwein et al. 2009). Such introductions were done by ligation of gene fragments, cut with suitable restriction enzymes.

Construction of JFH1-Based HCV Recombinant with Core-NS2 of Genotype 1-7 Containing Genotype-Specific 5'UTR and Heterotypic 1a and 3a 5'UTR Previously developed JFH1-based HCV recombinant of genotype 1-7 all contain JFH1 5'UTR (genotype 2a), genotype-specific Core-NS2, and JFH1 NS3-3'UTR sequences (Lindenbach et al. 2005), (Gottwein et al. 2007), (Scheel et al. 2008), (Jensen et al. 2008), and (Gottwein et al. 2009). In the present study, we replaced the JFH1 5'UTR with genotype-specific homotypic 5'UTR for Core-NS2 recombinants of genotype 1-6 and with 1a (H77 isolate) and 3a (S52 isolate) 5'UTR for Core-NS2 recombinants of genotype 1-7 using fusion PCR and standard cloning procedures. The 5'UTR of 1a, 2a, 3a (S52 isolate) and 4a (ED43 isolate) were amplified from consensus full-length clones pCV-H77C (Yanagi et al. 1997), pJ6CF (Yanagi et al. 1999), pS52 (Gottwein J unpublished data) and pED43 (Sheels T, unpublished data), respectively; the 5'UTR of 1b (HC-J4 isolate) and 6a (HK6a isolate) were amplified from plasma pools of experimentally infected chimpanzees by RT-PCR with genotype-specific primers containing 12 and 14 consensus nucleotide (nt) at 5'-end, respectively; the 5'UTR of 2b (HC-J8 isolate) and 5a (SA13 isolate) were amplified from 5'UTR-containing plasmids made from infected chimpanzee plasma pool by RT-PCR. Since the 5' terminal sequences of 3a (S52), 4a (ED43), 5a (SA13) and 6a (HK6a) were genotype-specific consensus sequences previously derived from HCV database, the 5'UTR sequences of these genotypes were further determined by performing rapid amplification 5' cDNA ends (5'RACE) procedure on chimpanzee plasma pools infected with HCV 4a (ED43) and 5a (SA13), and on 3a (S52) and 6a (HK6a) infected-mouse serum. The 5'UTR of 1b and 2b were referred to sequences determined in patient serum infected with the same isolate that was used to inoculate chimpanzee for generation of the plasma pools. Thus, the 5'UTR sequences of respective isolates used in the study are isolate-authentic (the 3a 5'UTR sequence is still being investigated by 5'RACE). The amplified 5'UTRs were PCR-fused to Core-NS2 recombinant constructs of genotype 1-7. The PCR fusion products were cloned into the original constructs by various cleavage sites to obtain JFH1-based intergenotypic HCV recombinants containing either genotype-specific 5'UTR or heterotypic 1a 5'UTR and 3a 5'UTR. A T7 promoter sequence was added immediately up stream of the 5'UTR for the in vitro transcription of the recombinant HCV genome. A guanine was inserted between T7 RNA promoter and 5'UTR of 2a, 4a and 5a, which have a residue A at position 1.

PCRs were carried out with Pfu Polymerase (Stratagene). Restriction enzymes for standard cloning procedures were purchased from New England Biolabs and ligations were carried out using Rapid DNA ligation kit (Roche) according to the protocol. DNA preparations were carried out using QIAprep spin miniprep, QIAfilter plasmid maxi kit or HISpeed plasmid Maxi kit (all Qiagen). The sequences of constructed plasmids were confirmed by sequencing analysis (Macrogen Inc., Korea).

In Vitro Transcription

For in vitro transcription 5 µg plasmid was XbaI-linearized (New England Biolabs). Transcription was carried out for 2 hrs with T7 RNA polymerase (Promega) according to protocol. RNA production was evaluated by gel electrophoresis.

Huh7.5 Cell Culture and Generation of Virus Stocks

The human hepatoma cell line Huh7.5 is an INF-α cured clone of the Huh7 hepatoma cell line, with increased HCV replication abilities. Cells were cultured in D-MEM+4500 mg/L Glucose+GlutaMAX-I+Pyruvate (Invitrogen) containing 10% heat inactivated fetal bovine serum (FBS) (Sigma), penicillin at 100 units/ml and streptomycin at 100 mg/ml (Invitrogen) at 5% $CO_2$ and 37° C. Every 2-3 days cells were split after washing with PBS and trypsinizing (Trypsin/EDTA, Invitrogen). Supernatants were sterile filtered to exclude cells and debris and stored at −80° C.

For transfection of HCV RNA transcripts, naïve Huh7.5 cells were plated at $4 \times 10^5$/well in 6-well plates the day before transfection. Prior to transfection 2.5 µg of unpurified RNA transcripts were incubated with Lipofectamine-2000 (Invitrogen) in 500 µL Opti-MEM (Invitrogen) for 20' at room temperature. RNA-Lipofectamine-2000 transfection complexes were left on cells for 12-24 hrs before washing.

To prove the production of infectious viruses, sterile filtered supernatant from infected cultures was used to infect naïve Huh7.5 cells. Unless other is described, 1 mL supernatant was used for infection of Huh7.5 cells plated in 6-well plates at 4×10$^5$/well the day before. Supernatants were left on cells for 3-8 hrs.

Negative controls in transfections were RNA transcripts from replication deficient JFH1-based genomes (with the GND motif); supernatant from cultures transfected with GND-transcripts was used as negative control for passage experiments (data not shown).

Viral spread was monitored by HCV Core and NS5A immunostainings with mouse anti-HCV core protein monoclonal antibody (B2) (Anogen, Yes Biotech Laboratories) or anti-NS5A, 9E10, respectively, as described in the following section. For reporter viruses tagged with fluorescent reporter gene, viral spread was also monitored by direct visualization of the reporter gene by fluorescence microscopy. For reporter viruses tagged with hRLuc reporter gene, viral spread was also monitored by luminescence-based assay as described below. Supernatant infectivity titers were determined as 50% tissue culture infectious dose ($TCID_{50}$)/mL or as focus forming units (FFU)/mL, as described in the following section. Supernatant HCV RNA titers were measured by a 5' UTR based Real Time RT-PCR as described below.

For generation of virus stocks, Huh7.5 cells were infected at a multiplicity of infection (MOI) of ~0.003. After viral spread to >80% of the culture (Core or NS5A immunostaining), supernatants were filtered, aliquoted and stored at −80° C. Size of each viral stock was ~100 mL.

Immunostainings for HCV Antigens; Titration of Infectivity

For staining, cells grown over night on 4- or 8-well chamber slides (Nunc) were washed 2× with PBS and fixed for 5 minutes with acetone. After washing 2× with PBS and 1× with PBS/Tween-20 (0.1%), slides were incubated with 1° antibody (MAB Murine Anti-Human HCV, Core Protein, Clone B2 (Anogen) or anti-NS5A, 9E10 (gift from C. Rice, Rockefeller University) used at 1:200 in PBS containing 5% bovine serum albumine (BSA) for 20' at room temperature. After washing as above, 2° antibody (Alexa Fluor 594 goat anti-mouse IgG (H+L)) and Hoechst33342 (both Invitrogen) for cell nuclei counterstaining, used at 1:500 and 1:10000 dilutions, respectively in PBS/Tween, was added for 5 min. Finally, slides were washed with PBS, mounted with Fluoromount-G (Southern Biotech) and cover slipped. Staining was visualized using a Leica TCS confocal microscope. Percentage of infected cells was evaluated by assigning values of 0% (no cells infected), 1% (or below), 5%, 10-90% in steps of 10, 95% and 100% (all cells infected).

Detection of Luminescence by *Renilla* Luciferase Assay

Huh7.5 cells infected with hRLuc expressing viruses and non-infected negative control cells were pelleted in Eppendorf tubes at 14000 rpm for 5 min (approximately 10 000 cells/sample). After centrifugation, samples were kept at −80° C. and *Renilla* Luciferase Assay (Promega) was carried out according to the manufacturer's protocol. Luminescence was detected on a luminescence plate reader (FLUOstarOPTIMA microplate reader; BMG).

Viral infectivity titers were determined by the tissue culture infectious dose 50 ($TCID_{50}$) or focus forming unit method. 6×10$^3$/well naive Huh7.5 cells were plated out in a poly-D-lysine coated 96-well plate (Nunc) the day before infection. Cells were then incubated with 10-fold dilutions of cell culture supernatants. For $TCID_{50}$ determinations, 6 replicates per dilution were incubated for 2-3 days. For FFU determinations, wells were incubated for 48 rs. After incubation, cells were permeabilized for 5' with cold methanol. After washing 1× with PBS and 1× with PBS/Tween-20, blocking was carried out for 20' with sterile filtered 1% BSA/0.2% skim milk in PBS followed by a 5' blocking of endogenous peroxidase activity using 3% H2O2. Cells were washed as above and incubated with a 1:200 dilution of 1° Ab α-NS5A (9E10) in PBS/0.1% tween-20 over night at 4° C. After washing, a 1:300 dilution of 2° Ab HRP-goat anti-mouse IgG (H+L) (Amersham Biosciences) in PBS/0.1% tween-20 was added and incubated for 30' at room temperature. Staining was developed using DAB substrate kit (DAKO) for 30' after washing. In $TCID_{50}$ determinations, wells were scored positive if one or more cells were infected, and the $TCID_{50}$ was calculated according to the Reed and Muench method. $TCID_{50}$ values are derived from single or multiple determinations as indicated. FFU determinations are based on counts of wells with 5-100 FFU and three independent virus dilutions with one replicate each. Counts were obtained by counting FFU by eye or by using automated counting on an ImmunoSpot Series 5 UV Analyzer (CTL Europe GmbH) with customized software kindly provided by CTL. From FFU counts in experimental wells, the mean of spot counts of at least 6 negative control wells was subtracted (~usually 3 to 15 spots). Count numbers were comparable to manual counting, and in general counts of up to 200 FFU/well were considered reliable, because they were in the linear range of dilution series, carried out in an establishment phase.

Real-time PCR (TaqMan) assay for determination of HCV RNA titers Supernatant HCV RNA titers were measured by a 5' UTR based Real Time RT-PCR. RNA was purified from 200 µL of heat inactivated (56° C. for 30') cell culture supernatant and eluted in a final volume of 50 µL using the Total Nucleic Acid Isolation Kit (Roche) in combination with the Total NA Variable Elution Volume protocol on a MagNA Pure LC Instrument (Roche). As an internal control, Phocine Distemper Virus (PDV) was added to the lysis buffer in a concentration titrated to yield a Ct of ~32 upon real-time PCR analysis. In parallel to RNA purified from cell culture supernatants a quantitative HCV standard panel covering RNA concentrations of 0 to 5×10$^6$ IU/mL in one-log increments (OptiQuant HCV Panel, AcroMetrix) was analysed. Real-time PCR analyses of HCV and PDV RNA were carried out in two separate reactions using the TaqMan EZ RT-PCR Kit (Applied Biosystems). For HCV, primers and a FAM-labelled MGB-probe were directed against the 5' UTR and were previously shown to perform equivalently against a panel of the six major HCV genotypes in a different TaqMan assay (Engle et al. 2008). For PDV, a ready-to-use primer/probe mix was used (Dr. H. G. M. Niesters, Department of Virology, Erasmus Medical Centre, Rotterdam, The Netherlands). The PCR analysis was performed on a 7500 Real-Time PCR System (Applied Biosystems) using 50° C. for 2', 60° C. for 30' and 95° C. for 5' followed by 45 cycles of 94° C. for 20" and 62° C. for 1'. HCV RNA titers (IU/ml) were calculated using a standard curve created from the known concentrations of the standard panel and their corresponding Ct values. The reproducible detection limit of the assay was 500 IU/ml. In order to confirm successful purification, amplification and the absence of PCR inhibitors, the Ct value of the PDV reaction was compared to the expected Ct value (based on a mean of all previous runs; n>9) using the MedLab QC freeware programme. The results of samples with an actual Ct value within ±25D of the expected Ct value were accepted.

Sequencing of Cell Culture Derived HCV

Direct sequencing of complete ORF was done to identify adaptive mutations. RNA was extracted from plasma and cell culture supernatant using the High Pure Viral Nucleic Acid Kit (Roche) according to manufacturer's protocol. Reverse transcription-polymerase chain reactions (RT-PCR) were carried out using RNA extracted from 100 µL cell culture supernatant. Primers (TAG Copenhagen) were 1.25 µM and dNTPs (Invitrogen) were 0.5 mM in RT reactions. For denaturation, RNA was incubated for 2' at 65° C. together with primer and dNTPs and placed on ice. cDNA syntheses was done in a 20 µL volume with SuperScriptIII (Invitrogen). The final RT reaction was treated with 1-4 U RNase H (Invitrogen) and 1000 U RNase T1 (Ambion) for 20' at 37° C. to degrade RNA. 1st round PCR was performed in a 50 µL volume on 2.5 µL of the cDNA reaction using the Advantage 2 PCR Enzyme System (Clontech). Cycle parameters were 5 cycles of 35" at 99° C., 30" at 67° C. and 10' at 68° C., 10 cycles of 35" at 99° C., 30" at 67° C. and 11' at 68° C., 10 cycles of 35" at 99° C., 30" at 67° C. and 12' at 68° C. and 10 cycles of 35" at 99° C., 30" at 67° C. and 13' at 68° C. 12~1 kb products were synthesized in a nested PCR covering the entire ORF. PCR was set up as above using 2.5 µL of the 1st round PCR for each reaction. Initial denaturation was 35 sec at 99° C. followed by 35 cycles with 35 sec at 99° C., 30 sec at 67° C. and 6 min at 68° C.

Sequencing, Sequence Analysis and Databases

All sequence reactions were carried out at Macrogen Inc., Seoul, South Korea. Sequence analysis was carried out with Sequencher 4.7, Gene Codes Corporation and freeware Bio-Edit v. 7.0.5. HCV sequences used for alignments were retrieved from The European HCV database (euHCVdb; http://euhcvdb.ibcp.fr/euHCVdb/) and the American HCV database (LANL; http://hcv.lanl.gov/content/hcv-db/index).

Rapid Amplification of 5' Complementary DNA Ends (5'RACE)

To determine the 5'UTR of the viruses, we used 5'RACE System for Rapid Amplification of cDNA Ends, Version 2.0 (Invitrogen) with dC or dA tailing technology, according to the manufacture's instruction. RNA was extracted from 200 µl of cell culture supernatant or infected chimpanzee plasma pools with TRIzol Reagent or Trizol LS Reagent (Invitrogen). The RNA was denatured at 70° C. for 10 min, and cDNA was synthesized at 42° C. for 30 min with SuperScript™ II RT (Invitrogen) and genotype-specific antisense primers'. After cDNA purification and tailing, the first PCR was performed with genotype-specific antisense primers, followed by nested PCR with genotype-specific primers. The PCR products were direct sequenced or cloned into pCR2.1-TOPO (Invitrogen) for sequencing. To determine the 3'-terminal sequence, RNA was extracted from cells collected at peak infection. 5'RACE was performed on negative-strand of HCV RNA using 5'/3' RACE Kit, 2nd Generation (Roche), following the manufacture's protocol. PCR products were cloned into pCR2.1-TOPO (Invitrogen), 5-7 clones were sequenced. The consensus sequence was considered 3'UTR sequence.

Example 1

Development of J6/JFH1 EGFP-Tagged Reporter Viruses

J6/JFH1-EGFP reporter virus was constructed by in frame insertion of the EGFP coding sequence in domain III of NS5A of the J6/JFH reference recombinant (immediately downstream of NS5A codon 418, relating to the J6/JFH and the H77 reference sequence).

In two independent transfections of Huh7.5 cells with RNA transcripts, J6/JFH1-EGFP viruses spread to >50% of the cells after an eclipse phase of 13 and 19 days, respectively, compared to J6/JFH virus, which spread immediately (FIGS. 1A and B). At day 15 of the 1$^{st}$ transfection experiment (FIG. 1A), J6/JFH1-EGFP yielded an infectivity titer of 10$^{4.3}$ FFU/ml compared to 10$^{4.1}$ FFU/ml for J6/JFH. On day 19 of the 2$^{nd}$ transfection experiment, J6/JFH1-EGFP yielded 10$^{3.8}$ FFU/ml. In 1$^{st}$ and 2$^{nd}$ passage experiments of virus from one transfection experiment (FIG. 1A), J6/JFH1-EGFP showed spread kinetics and HCV RNA titers comparable to J6/JFH (example of 1$^{st}$ passage experiment shown in FIG. 1C). Also infectivity titers were comparable at 10$^{3.2}$ FFU/ml for J6/JFH1-EGFP and 10$^{3.3}$ FFU/ml for J6/JFH (day 10 of 1$^{st}$ passage shown in FIG. 1C). Direct sequencing of the complete open reading frame (ORF) of viral genomes from 1$^{st}$ transfection (FIG. 1A, day 15) and consecutive passage culture supernatant (FIG. 1C, day 8 and data not shown) revealed deletion of nt 7016-7135 (relating to the entire J6/JFH1 genome; leading to deletion of aa 250-289 in JFH1 NS5A protein) in NS5A, upstream of the introduced EGFP sequence. In the 2$^{nd}$ transfection experiment (FIG. 1B, day 19) nt 7065-7139 (relating to the entire J6/JFH1 genome; leading to deletion of aa 250-289 in JFH1 NS5A protein) were deleted. Sequence analysis from the two transfections and several passage experiments derived from the 1$^{st}$ transfection indicated, that J6/JFH1-EGFP did not require additional adaptive mutations. A deletion of nt 7016-7135 (leading to deletion of aa 250-289 in JFH1 NS5A protein) was selected for analysis in reverse genetic studies. J6/JFH1-EGFPΔ (nucleotide acid SEQ ID NO: 3, amino acid SEQ ID NO: 13) spread as efficiently as J6/JFH1 in transfection and 1$^{st}$ passage experiments (FIGS. 2 A and B). On day 8 of the 1$^{st}$ passage (FIG. 2B), infectivity titers were 10$^{4.3}$ FFU/ml and sequence analysis showed, that J6/JFH1-EGFPΔ was genetically stable, thus confirming, that deletion of nt 7016-7135 was sufficient to confer cell culture adaptation.

Example 2

Development of EGFP-Tagged Reporter Viruses of the Major HCV Genotypes

In order to develop a panel of EGFP-reporter viruses of the major HCV genotypes, JFH1-based intergenotypic recombinants containing Core through NS2 sequences of prototype isolates of genotypes 1a (H77 and TN), 1b (J4), 2b (J8), 3a (S52), 4a (ED43), 5a (SA13), 6a (HK6a) and 7a (QC69) are used. We have previously shown, that with exception of 2b and 7a, viability of these recombinants depended on cell culture adaptive mutations. For development of EGFP-tagged reporter constructs, we chose JFH1-based intergenotypic recombinants with optimal combinations of such cell culture adaptive mutations. It should be noted that for some of these recombinants (e.g. S52/JFH1), several combinations of mutations were shown to be efficient, and in theory several different EGFP-tagged reporter viruses could be constructed, using differently adapted genomes.

In a first set of experiments, the following viruses were tested: H77/JFH1-EGFPΔ (with H77/JFH1 cell culture adaptive mutations T2700C,A4080T encoding amino acid changes V787A,Q1247L) (nucleotide SEQ ID NO: 69, amino acid SEQ ID NO: 89), S52/JFH1-EGFPΔ (with S52/JFH1 cell culture adaptive mutation A4550C encoding amino acid change K1404Q) (nucleotide SEQ ID NO: 73, amino acid SEQ ID NO: 93), ED43/JFH1-EGFPΔ (with ED43/JFH1 cell culture adaptive mutations T827A,T977S) (nucleotide SEQ ID NO: 74, amino acid SEQ ID NO: 94), SA13/JFH1-EGFPΔ (with SA13/JFH1 cell culture adaptive mutations A2819G, A3269T encoding amino acid changes A1022G,K1119R) (nucleotide SEQ ID NO: 75, amino acid SEQ ID NO: 95) and HK6a/JFH1-EGFPΔ (with HK6a/JFH1 cell culture adaptive mutations T1389C,A1590C encoding amino acid changes F350S,N417T) (nucleotide SEQ ID NO: 76, amino acid SEQ ID NO: 96). Subsequently, we developed a panel of EGFP-tagged reporter viruses of JFH1-based recombinants with Core-NS2 of all major HCV genotypes and important subtypes (see below in Examples 2).

After transfection, H77/JFH1-EGFPΔ, ED43/JFH1-EGFPΔ, SA13/JFH1-EGFPΔ and HK6a/JFH1-EGFPΔ spread to infect most cells of the culture in 6 to 10 days, comparable to J6/JFH1-EGFPΔ, which infected most cells on day 8 post transfection (FIG. 3A). In an independent transfection experiment, S52/JFH1-EGFPΔ spread to >50% of the culture on day 67 and infected almost the complete cell culture on day 69 (data not shown). This delay in viral spread was not observed in consecutive experiments and might have been due to a technical problem. In a consecutive 1$^{st}$ passage experiment, all reporter viruses, spread to the complete cell culture in 6-10 days, with the exception of H77/JFH1-EGFPΔ infecting the majority of cells on day 17 (FIG. 3B). It seems likely, that this delay might be due to differences in the infectious dose used for inoculation. Infectivity titers at the peak of infection are given in Table 1.

Subsequently, we developed a panel of EGFP-tagged reporter viruses of JFH1-based recombinants with Core-NS2 of all major HCV genotypes and important subtypes. Thus, in a second set of experiments, we transfected Huh7.5 cells with RNA transcripts from the following EGFP reporter plasmids: pH77/JFH1(T2700C,A4080T)-EGFPΔ (SEQ ID NO: 69, encoded amino acid SEQ ID NO: 89); pTN/JFH1(T2700C, A4080T)-EGFPΔ (SEQ ID NO: 70, encoded amino acid SEQ ID NO: 90); pJ4/JFH1(T2996C,A4827T)-EGFPΔ (SEQ ID NO: 71, encoded amino acid SEQ ID NO: 91); pJ6/JFH1-EGFPΔ (SEQ ID NO: 3, encoded amino acid SEQ ID NO: 13); pJ8/JFH1-EGFPΔ (SEQ ID NO: 4, encoded amino acid SEQ ID NO: 14); pS52/JFH1(T2718G,A4550C)-EGFPΔ (SEQ ID NO: 72, encoded amino acid SEQ ID NO: 92); pS52/JFH1(A4550C)-EGFPΔ (SEQ ID NO: 73, encoded amino acid SEQ ID NO: 93); pED43/JFH1(A2819G, A3269T)-EGFPΔ (SEQ ID NO: 74, encoded amino acid SEQ ID NO: 94); pSA13/JFH1(C3405G,A3696G)-EGFPΔ (SEQ ID NO: 75, encoded amino acid SEQ ID NO: 95); pHK6a/JFH1(T1389C,A1590C)-EGFPΔ (SEQ ID NO: 76, encoded amino acid SEQ ID NO: 96); pQC69/JFH1(T2985C, C9018T)-EGFPΔ (SEQ ID NO: 77, encoded amino acid SEQ ID NO: 97). A positive control cell culture was transfected with RNA transcripts from pJ6/JFH1. After transfection, EGFP reporter viruses of all genotypes spread as fast as the positive control virus J6/JFH1 and infected the complete culture on day 3-6 after transfection (data not shown). Peak infectivity titers of transfection cultures were between 4.0-5.5 log 10 FFU/ml. We used virus-containing supernatants from transfection cultures at the peak of infection to infect naïve Huh7.5 cells with the same infectious dose of each virus (FIG. 8). In these first passage cultures, all viruses spread to the complete cell culture in 5-11 days. EGFP reporter activity was easily detectable with fluorescent microscopy (FIG. 8A) and flow cytometry (FIG. 8B). Infectivity titers at time points, at which infection peaked in this first passage, were between 4.0-5.5 log 10 FFU/ml (FIG. 9), thus being comparable to the infectivity titers observed for the respective non-tagged recombinants. At peak of infection of this first passage, genomes derived from cell culture supernatant were sequenced for all EGFP-reporter virus cultures. In direct sequence analysis of the complete open reading frame, we did not detect any nucleotide changes compared to the plasmids used for generation of RNA transcripts. Thus, the developed constructs were all genetically stable in cell culture. The engineered sequence encoded fully functional viral genomes giving rise to viruses that did not need further cell culture adaptation.

Example 3

Development of J6/JFH1 *Renilla* Luciferase-Tagged Reporter Viruses

In order to enable high throughput luminescence-based assays, we aim at constructing luciferase-tagged reporter viruses. We thus inserted *Renilla* luciferase immediately downstream of codon 418 in J6/JFH1 NS5A with and without the identified deletion (nt 7016-7135, leading to deletion of aa 250-289 in JFH1 NS5A protein).

After transfection of Huh7.5 cells, J6/JFH1-hRluc spread to the complete cell culture on day 28 (FIG. 4A). When transfection supernatant was passed to naïve Huh7.5 cells, this virus spread to the complete culture on day 20 (FIG. 4B). In the same experiment, a transfection with J6/JFH1-hRlucΔ (nucleotide SEQ ID NO: 10, amino acid SEQ ID NO: 20), with deletion of nt 7016-7135 as identified in culture experiments of J6/JFH1-EGFP, was carried out. J6/JFH1-hRlucΔ spread to the majority of culture cells on day 20 (FIG. 4B) and infectivity titers on day 18 and 21 post transfection were $10^{4.9}$ and $10^{4.3}$ FFU/ml, respectively. In contrast, in subsequent experiments J6/JFH1-hRlucΔ spread without delay after transfection. Delayed viral spread in this experiment was most likely due to a technical problem.

This experiment was repeated twice (FIG. 10). In FIG. 10 A and FIG. 10 C, transfection with RNA transcripts from constructs pJ6/JFH1-hRlucΔ (nucleotide SEQ ID NO: 10, amino acid SEQ ID NO: 20), J6/JFH1-hRluc and pJ6/JFH1 is shown.

In both experiments, viral spread of J6/JFH1-hRlucΔ was comparable to that of J6/JFH1. In contrast, viral spread of J6/JFH1-hRluc was impaired. During long term culture, spread to most cells of the culture was observed, however, in the same culture cells with high expression of HCV NS5A and low expression of HCV NS5A were observed (FIG. 10 A), indicating that 2 virus populations might be present; one virus population that was adapted to cell culture and led to high expression of NS5A in the infected cells, and another virus population that was not well adapted and expressed low levels of NS5A. When viral supernatant from transfection cultures was passaged to naïve cells (FIG. 10 B, D), different courses of infection were observed. Once (FIG. 10 B), J6/JFH1-hRluc spread rapidly; however, sequence analysis of viral genomes revealed, that this virus had deleted the hRluc reporter gene from its genome. In another 1$^{st}$ passage experiment (FIG. 10 D), J6/JFH1-hRluc spread inefficiently. In conclusion, the data shown in FIG. 10 indicate, that the identified 40 amino acid deletion led to viability of J6/JFH1 with hRluc reporter gene inserted in NS5A. In contrast, J6/JFH1 with hRluc reporter gene without the identified deletion showed strongly impaired viability, which first was improved after the virus had eliminated the hRluc gene.

We then did comparative kinetic studies with pJ6/JFH1-hRlucΔ (nucleotide SEQ ID NO: 10, amino acid SEQ ID NO: 20) and pJ6/JFH1 (FIG. 11). After infection of Huh7.5 cells with the same dose of each virus, J6/JFH1-hRlucΔ and J6/JFH1 showed comparable spread kinetics, infecting the complete cell culture in 5-7 or in 9 days, depending on the infectious dose used (FIG. 11A). Peak infectivity titers of supernatants from cultures completely infected with J6/JFH1-hRlucΔ were 4-4.5 logs FFU/ml, comparable to infectivity titers found for J6/JFH1 (FIG. 11B). Finally, we detected luminescence activity of the hRluc reporter with a luminescence plate reader. Luminescence increased during the course of infection and was, at the peak of infection, 3.5 logs RLU higher than luminescence of naïve cells (FIG. 11 C). Direct sequence analysis of viral genomes derived from peak of infection of this 1$^{st}$ passage experiment showed that J6/JFH1-hRlucΔ was genetically stable and did not require additional adaptive mutations. Thus, the identified deletion (nt 7016-7135, leading to deletion of JFH1 NS5A aa 250-289) allowed insertion of hRluc in NS5A of J6/JFH1.

We then developed a panel of hRluc reporter viruses of JFH1-based recombinants with Core-NS2 of the major HCV genotypes. RNA transcripts of the following plasmids were transfected into Huh7.5 cells: pH77/JFH1(T2700C, A4080T)-hRlucΔ (nucleotide SEQ ID NO: 80, amino acid SEQ ID NO: 100); pTN/JFH1(T2700C,A4080T)-hRlucΔ (nucleotide SEQ ID NO: 81, amino acid SEQ ID NO: 101); pJ4/JFH1(T2996C,A4827T)-hRlucΔ (nucleotide SEQ ID NO: 82, amino acid SEQ ID NO: 102); pJ6/JFH1-hRlucΔ (nucleotide SEQ ID NO: 10, amino acid SEQ ID NO: 20); pJ8/JFH1-hRlucΔ (nucleotide SEQ ID NO: 83, amino acid SEQ ID NO: 103); pS52/JFH1(T2718G,A4550C)-hRlucΔ (nucleotide SEQ ID NO: 84, amino acid SEQ ID NO: 104); pED43/JFH1(A2819G,A3269T)-hRlucΔ (nucleotide SEQ ID NO: 85, amino acid SEQ ID NO: 105); pSA13/JFH1 (C3405G,A3696G)-hRlucΔ (nucleotide SEQ ID NO: 86, amino acid SEQ ID NO: 106); pHK6a/JFH1(T1389C, A1590C)-hRlucΔ (nucleotide SEQ ID NO: 87, amino acid SEQ ID NO: 107); pQC69/JFH1(T2985C,C9234T)-hRlucΔ (nucleotide SEQ ID NO: 88, amino acid SEQ ID NO: 108); and pJ6/JFH1 as positive control. This led in all cases to viral infection that spread to the complete culture in 7-14 days (FIG. 12 A). At peak of infection, relatively high infectivity titers were found in supernatants from transfection cultures (Table 3). At peak of infection, lysates of transfected cells showed luminescence, indicating presence of hRluc reporter gene (FIG. 12 B). Supernatants from time points with peak infection in transfection cultures were used for passage in naïve Huh7.5 cells (FIG. 13). All viruses spread to the complete cell culture; different spread kinetics are most probably due to differential input dose (FIG. 13 A). At the peak of infection of this 1$^{st}$ passage experiment, a strong luminescence signal was detected for all genotype recombinants in lysates of infected cells, confirming presence and activity of the hRluc reporter (FIG. 13B). We commenced direct sequence analysis of the complete open reading frame of viral genomes derived from 1$^{st}$ passage cell culture supernatants at the peak of infection. At the time point of submission of this document, the data were not completed. However, we confirmed that the hRluc reporter sequence was maintained in hRlucΔ recombinants with Core-NS2 of all different genotype isolates tested. This is in contrast to J6/JFH1-hRluc, which deleted hRluc gene in one experiment (FIG. 10 A, B). Thus, the present inventors developed a panel of hRluc reporter viruses with Core-NS2 of all major HCV genotypes.

Example 4

Importance of Deletion of nt 7016-7135 for J6/JFH Viability

In order to investigate the importance of nt 7016-7135 (leading to deletion of aa 250-289 in JFH1 NS5A protein) for J6/JFH viability, we constructed J6/JFH1Δ with deletion of these nucleotides. After transfection of Huh7.5 cells, J6/JFH1Δ spread as efficiently as J6/JFH (FIG. 5) and yielded comparable supernatant infectivity titers (FIG. 6). Thus, viability of J6/JFH1 was not impaired by the deletion conferring viability to J6/JFH1-EGFP.

Example 5

Importance of Deletion of nt 7065-7139 for J6/JFH1 Viability

In order to investigate the importance of nt 7065-7139 (leading to deletion of aa 266 to 290 in JFH1 NS5A protein) for J6/JFH viability, we constructed J6/JFH1Δ25. In a transfection experiment, both J6/JFH1 and J6/JFHΔ25 spread with similar kinetics (FIG. 7), indicating, that this deletion did not either impair viability of J6/JFH1.

Example 6

We also tested, if the identified deletion (nt 7016-7135, leading to deletion of JFH1 NS5A aa 250-289) allowed insertion of other reporter genes in J6/JFH1. Thus, we generated pJ6/JFH1-CherryΔ and pJ6/JFH1-DSRedΔ by insertion of red fluorescent proteins, either mCherry or DSRed Express2, immediately downstream of codon 418 in J6/JFH1 NS5A. After transfection of RNA transcripts, J6/JFH1-CherryΔ and J6/JFH1-DSRedΔ infected the complete cell culture on day 4, comparable to J6/JFH1 (FIG. 14 A). Red fluorescence was detectable with a fluorescent microscope. After infection of naïve Huh7.5 cells with the same infectious dose of each virus, rapid viral spread occurred (FIG. 14 B). Peak infectivity titers of J6/JFH1-CherryΔ and J6/JFH1-DSRedΔ were between 4.5-5 logs FFU/ml, comparable to those of J6/JFH1 (FIG. 14 C).

Example 7

The present inventors constructed and tested JFH1-based recombinants with genotype-specific Core-NS2 with either (i) homotypic 5'UTR, (ii) heterotypic genotype 1a 5'UTR or (iii) heterotypic genotype 3a 5'UTR spread efficiently in Huh7.5 cells after transfection. Because previously developed JFH1-based intergenotypic recombinant cell culture systems with Core-NS2 of genotype 1-7 all contain JFH1 5'UTR, in the present study the inventors (i) replaced the JFH1 5'UTR of Core-NS2 recombinants of genotype 1-6 with genotype specific homotypic 5'UTR. For Core-NS2 recombinants of genotype 1-7, the inventors replaced the JFH1 5'UTR (ii) with heterotypic genotype 1a (H77) 5'UTR, or (iii) with heterotypic genotype 3a (S52) 5'UTR. In a transfection experiment, viruses with homotypic and genotype 1a or 3a heterotypic 5'UTR showed spread kinetics similar to viruses with JFH1 5'UTR (FIG. 15). Infectivity titers of these viruses were also comparable and are shown in Table 4.

Example 8

The inventors directly compared JFH1-based recombinants with Core-NS2 of genotype 2a or 3a with 5'UTR of genotypes 1a, 2a, or 3a after inoculation of Huh7.5 cells at the same MOI (0.003 MOI). All viruses showed similar spread kinetics (FIG. 16) as well as HCV RNA and infectivity titers (FIG. 17).

Example 9

JFH1-based recombinants with Core-NS2 of genotypes 1a, 1b, 2b, 4a, 5a and 6a with genotype-specific homotypic 5'UTR were directly compared to the respective recombinants with JFH1 5'UTR after inoculation of Huh7.5 cells at the same MOI (0.003 MOI). The inventors showed that recombinants with Core-NS2 of genotypes 1a, 1b, 2b, 4a, 5a and 6a with genotype-specific homotypic 5'UTR showed similar virus-spread kinetics, RNA and infectivity titers as the respective recombinants with JFH1 5'UTR (FIG. 18). JFH1-based recombinants with Core-NS2 of genotype 1-6 with genotype-specific homotypic 5'UTRs and heterotypic genotype 1a and 3a 5'UTRs did not require major adaptation in cell culture with exemption of nt 1 of the 5'UTR which apparently requires residue A in cell culture (FIG. 19). This is an interesting finding, since in vivo residue G seems permissible. Residue A might be required due to interaction with the JFH1 NS5B RNA dependent RNA polymerase.

Example 10

To further study of the 5'UTR in an identical genetic background, the inventors replaced the JFH 5'UTR of J6/JFH also with the 5'UTR of genotypes 1b (J4), 2b (J8), 4a (ED43), 5a (SA13) and 6a (HK6a). Together with previously developed J6/JFH1 recombinants containing 5'UTR of genotypes 1a (H77), 2a (J6) and 3a (S52), the inventors have completed a panel of J6/JFH1 recombinants with 5'UTR of genotype 1-6. J6/JFH1 recombinants with 5'UTR of genotype 1-6 efficiently spread in Huh7.5 cells in a transfection and viral passage experiment and had similar infectivity titers. In a transfection experiment, viral spread and infectivity titers were comparable to J6/JFH1 (FIG. 20). In a consecutive viral passage experiment, in which replicate cultures were inoculated at the same MOI, viral spread, HCV RNA titers and infectivity titers of J6/JFH1 recombinants with 5'UTR of genotype 1-6 were comparable to each other and to J6/JFH1 (FIG. 21). Sequencing of the 5'UTR of J6/JFH1 recombinants with 5'UTR of genotype 1-6 derived from viral passage culture, showed that nucleotide residue A was required at position 1 of the 5'UTR.

Tables

TABLE 1

Peak infectivity titers in 1st passage cell culture supernatants of EGFP-tagged viruses (FIG. 3B). For the complete set of viruses, compare FIG. 9.

| EGFP-tagged reporter virus | Day | Infectivity titer LOG10 (FFU/ml) |
|---|---|---|
| H77/JFH1-EGFPΔ | 17 | 4.2 |
| J6/JFH1-EGFPΔ | 10 | 4.8 |
| S52/JFH1-EGFPΔ | 10 | 3.9 |
| ED43/JFH1-EGFPΔ | 13 | 3.9 |
| SA13/JFH1-EGFPΔ | 6 | 4.1 |
| HK6a/JFH1-EGFPΔ | 10 | 4.1 |

TABLE 2

Examples of adaptive mutations able to adapt JFH1-based recombinants with Core-NS2 of the given genotype and EGFP or hRluc reporter gene inserted in NS5A

| Core-NS2 genotype | Isolate name | NT SEQ ID | AA SEQ ID | Adaptive mutations, nt | Adaptive mutations, aa |
|---|---|---|---|---|---|
| 1a | H77 | 1, 121 | 11, 129 | T2700C | V787A |
| 1a | H77 | 1, 121 | 11, 129 | A4080T | Q1247L |
| 1a | H77 | 1, 121 | 11, 129 | C4562T | R1408W |
| 1a | TN | 119, 122 | 120, 130 | T2700C | V787A |
| 1a | TN | 119, 122 | 120, 130 | A4080T | Q1247L |
| 1a | TN | 119, 122 | 120, 130 | G4631A | D1431N |
| 1a | TN | 119, 122 | 120, 130 | A5436G | E1699G |
| 1a | TN | 119, 122 | 120, 130 | C4562T | R1408W |
| 1b | J4 | 2, 123 | 12, 131 | T2996C | F886L |
| 1b | J4 | 2, 123 | 12, 131 | T2996G | F886V |
| 1b | J4 | 2, 123 | 12, 131 | T2996A | F886I |
| 1b | J4 | 2, 123 | 12, 131 | A4827T | Q1496L |
| 1b | J4 | 2, 123 | 12, 131 | A4274G | I1312V |
| 1b | J4 | 2, 123 | 12, 131 | A4532C | K1398Q |
| 1b | J4 | 2, 123 | 12, 131 | C4562T | R1408W |
| 2a | J6 | 3, 10 | 13, 20 | None | None |
| 2b | J8 | 4, 83 | 14, 103 | None | None |
| 3a | S52 | 5, 124 | 15, 132 | T2718G | I793S |
| 3a | S52 | 5, 124 | 15, 132 | T2718C | I793T |
| 3a | S52 | 5, 124 | 15, 132 | A2721G | Y794C |
| 3a | S52 | 5, 124 | 15, 132 | A4550C | K1404Q |
| 3a | S52 | 5, 124 | 15, 132 | A4845T | Q1502L |
| 3a | S52 | 5, 124 | 15, 132 | T7160C | S2274P |
| 4a | ED43 | 6, 125 | 16, 133 | A2819G | T827A |
| 4a | ED43 | 6, 125 | 16, 133 | A3269T | T977S |
| 5a | SA13 | 7, 126 | 17, 134 | C3405G | A1022G |
| 5a | SA13 | 7, 126 | 17, 134 | A3696G | K1119R |
| 5a | SA13 | 7, 126 | 17, 134 | C3068G | L910V |
| 5a | SA13 | 7, 126 | 17, 134 | A4083T | Q1248L |
| 5a | SA13 | 7, 126 | 17, 134 | A4277G | I1312V |
| 6a | HK6a | 8, 127 | 18, 135 | T1389C | F350S |
| 6a | HK6a | 8, 127 | 18, 135 | A1590C | N417T |
| 7a | QC69 | 9, 128 | 19, 136 | G809T | V157F |
| 7a | QC69 | 9, 128 | 19, 136 | T1581C | I414T |
| 7a | QC69 | 9, 128 | 19, 136 | T2985C | L882P |
| 7a | QC69 | 9 | 19 | C9018T | A2893V |
| 7a | QC69 | 128 | 136 | C9234T | A2965V |

TABLE 3

Peak infectivity titers in transfection and 1st passage cell culture supernatants of hRLuc-tagged viruses

| | Transfection | | Infection | |
|---|---|---|---|---|
| | Log10 (FFU/ml) | Day of Exp. | Log10 (FFU/ml) | Day of Exp. |
| H77/JFH1-hRluc | 2.0 | 12 | 3.3 | 23 |
| TN/JFH1-hRluc | 3.6 | 9 | 3.0 | 9 |
| J4/JFH1-hRluc | 3.1 | 9 | 3.4 | 16 |
| J6/JFH1-hRluc | 3.4 | 12 | 4.0 | 9 |
| J8/JFH1-hRluc | 2.7 | 14 | 3.6 | 14 |
| S52/JFH1-hRluc | 3.8 | 9 | 3.9 | 7 |
| ED43/JFH1-hRluc | 2.4 | 9 | 3.1 | 16 |
| SA13/JFH1-hRluc | 4.8 | 7 | 4.2 | 5 |
| HK6a/JFH1-hRluc | 3.5 | 9 | 3.4 | 9 |
| QC69/JFH1-hRluc | 2.8 | 12 | 3.9 | 16 |
| J6/JFH1 | 4.8 | 7 | 3.9 | 7 |

TABLE 4

Infectivity titers of transfection supernatants for JFH1-based intergenotypic HCV recombinants with different 5'UTRs.

| Genotype | | Day of post trans- fection | Log10 (FFU/mL) | SEM | Virus |
|---|---|---|---|---|---|
| Core-NS2 (isolate) | 5'UTR (isolate) | | | | |
| 1a (H77) | 2a (JFH1) | 5 | 3.54 | 0.04 | H77/JFH1$_{T2700C, A4080T}$ |
| | | 8 | 3.15 | 0.12 | |
| | 1a (H77) | 5 | 3.71 | 0.03 | H77$^{5'UTR-NS2}$/JFH1$_{T2701C, A4081T}$ |
| | | 8 | 3.20 | 0.02 | |

TABLE 4-continued

Infectivity titers of transfection supernatants for JFH1-based intergenotypic HCV recombinants with different 5'UTRs.

| Genotype Core-NS2 (isolate) | Genotype 5'UTR (isolate) | Day of post trans-fection | Log10 (FFU/mL) | SEM | Virus |
|---|---|---|---|---|---|
| | 3a (S52) | 5 | 2.99 | 0.03 | S52$^{5'UTR}$/H77$^{C\text{-}NS2}$/JFH1$_{T2699C, A4079T}$ |
| | | 8 | 2.41 | 0.06 | |
| 1b (J4) | 2a (JFH1) | 5 | 3.20 | 0.06 | J4/JFH1$_{T2996C, A4827T}$ |
| | | 8 | 2.24 | 0.04 | |
| | 1b (J4) | 5 | 2.47 | 0.05 | J4$^{5'UTR\text{-}NS2}$/JFH1$_{T2997C, A4828T}$ |
| | | 8 | 2.07 | 0.1 | |
| | 1a (H77) | 5 | 3.32 | 0.04 | H77$^{5'UTR}$/J4$^{C\text{-}NS2}$/JFH1$_{T2997C, A4828T}$ |
| | | 8 | 2.49 | 0.02 | |
| | 3a (S52) | 5 | 2.03 | 0.03 | S52$^{5'UTR}$/J4$^{C\text{-}NS2}$/JFH1$_{T2995C, A4826T}$ |
| | | 8 | 1.67 | 0.17 | |
| 2a (J6) | 2a (JFH1) | 5 | 3.94 | 0.07 | J6/JFH |
| | | 8 | 3.9 | 0.01 | |
| | 2a (J6) | 5 | 4.98 | 0.04 | J6$^{5'UTR\text{-}NS2}$/JFH1 |
| | | 8 | 3.94 | 0.01 | |
| | 1a (H77) | 5 | 4.01 | 0.03 | H77$^{5'UTR}$/J6$^{C\text{-}NS2}$/JFH1 |
| | | 8 | 3.35 | 0.07 | |
| | 3a (S52) | 5 | 3.98 | 0.07 | S52$^{5'UTR}$/J6$^{C\text{-}NS2}$/JFH1 |
| | | 8 | 3.15 | 0 | |
| 2b (J8) | 2a (JFH1) | 5 | 3.18 | 0.03 | J8/JFH1 |
| | | 8 | 2.64 | 0.02 | |
| | 2b (J8) | 5 | 3.94 | 0.1 | J8$^{5'UTR\text{-}NS2}$/JFH1 |
| | | 8 | 3.75 | 0.05 | |
| | 1a (H77) | 5 | 3.41 | 0.09 | H77$^{5'UTR}$/J8$^{C\text{-}NS2}$/JFH1 |
| | | 8 | 2.58 | 0.06 | |
| | 3a (S52) | 5 | 3.08 | 0 | S52$^{5'UTR}$/J8$^{C\text{-}NS2}$/JFH1 |
| | | 8 | 2.10 | 0.09 | |
| 3a (S52) | 2a (JFH1) | 5 | 4.26 | 0.19 | S52/JFH1$_{T2718G, A4550C}$ |
| | | 7 | 3.92 | 0.01 | |
| | 1a (H77) | 5 | 4.07 | 0.05 | H77$^{5'UTR}$/S52$^{C\text{-}NS2}$/JFH1$_{T2719G, A4551C}$ |
| | | 8 | 4.22 | 0.02 | |
| | 3a (S52) | 5 | 4.57 | 0.02 | S52$^{5'UTR\text{-}NS2}$/JFH1$_{T2717G, A4549C}$ |
| | | 8 | 4.53 | 0.03 | |
| 4a (ED43) | 2a (JFH1) | 5 | 4.19 | 0.08 | ED43/JFH1$_{A2819G, A3269T}$* |
| | | 7 | 3.68 | 0.04 | |
| | 4a (ED43) | 5 | 3.81 | 0.04 | ED43$^{5'UTR\text{-}NS2}$/JFH1$_{A2819G, A3269T}$* |
| | | 7 | 3.12 | 0.01 | |
| | 2a (JFH1) | 5 | 3.76 | 0.05 | ED43/JFH1$_{A2819G, A3269T}$ |
| | 1a (H77) | 5 | 3.64 | 0.06 | H77$^{5'UTR}$/ED43$^{C\text{-}NS2}$/JFH1$_{A2820G, A3270T}$ |
| | | 8 | 3.58 | 0.02 | |
| | 3a (S52) | 5 | 3.14 | 0.03 | S52$^{5'UTR}$/ED43$^{C\text{-}NS2}$/JFH1$_{A2818G, A3268T}$ |
| | | 8 | 3.64 | 0.03 | |
| 5a (SA13) | 2a (JFH1) | 5 | 4.98 | 0.05 | SA13/JFH1$_{C3405G, A3696G}$ |
| | | 8 | 3.31 | 0.11 | |
| | 2a (JFH1) | 5 | 4.88 | 0.00 | SA13/JFH1$_{C3405G, A3696G}$* |
| | | 7 | 4.67 | 0.06 | |
| | 5a (SA13) | 5 | 4.88 | 0.00 | SA13$^{5'UTR\text{-}NS2}$/JFH1$_{C3404G, A3695G}$ |
| | | 7 | 4.67 | 0.06 | |
| | 1a (H77) | 5 | 5.02 | 0.03 | H77$^{5'UTR}$/SA13$^{C\text{-}NS2}$/JFH1$_{C3406G, A3697G}$ |
| | | 8 | 3.41 | 0.05 | |
| | 3a (S52) | 5 | 4.48 | 0.02 | S52$^{5'UTR}$/SA13$^{C\text{-}NS2}$/JFH1$_{C3404G, A3695G}$ |
| | | 8 | 4.23 | 0.01 | |
| 6a (HK6a) | 2a (JFH1) | 5 | 4.75 | 0.05 | HK6a/JFH1$_{T1389C, A1590C}$* |
| | | 7 | 4.48 | 0.02 | |
| | 2a (JFH1) | 5 | 3.96 | 0.07 | HK6a/JFH1$_{T1389C, A1590C}$ |
| | | 8 | 3.31 | 0.04 | |
| | 6a (HK6a) | 5 | 4.57 | 0.02 | HK6a$^{5'UTR\text{-}NS2}$/JFH1$_{T1391C, A1592C}$* |
| | | 7 | 4.39 | 0.08 | |
| | 1a (H77) | 5 | 3.60 | 0.06 | H77$^{5'UTR}$/HK6a$^{C\text{-}NS2}$/JFH1$_{T1390C, A1591C}$ |
| | | 8 | 3.23 | 0.11 | |
| | | 5 | 3.29 | 0.02 | S52$^{5'UTR}$/HK6a$^{C\text{-}NS2}$/JFH1$_{T1388C, A1589C}$ |
| | 3a (S52) | 8 | 3.15 | 0.04 | |
| 7a (QC69) | 2a (JFH1) | 5 | 4.11 | 0.05 | QC69/JFH1 |
| | | 8 | 3.68 | 0.01 | |

TABLE 4-continued

Infectivity titers of transfection supernatants for JFH1-based intergenotypic HCV recombinants with different 5'UTRs.

| Genotype | | Day of post trans-fection | Log10 (FFU/mL) | SEM | Virus |
|---|---|---|---|---|---|
| Core-NS2 (isolate) | 5'UTR (isolate) | | | | |
| | 1a (H77) | 5 | 4.15 | 0.05 | H77$^{5'UTR}$/QC69$^{C-NS2}$/JFH1 |
| | | 8 | 3.92 | 0.12 | |
| | 3a (S52) | 5 | 3.70 | 0.13 | S52$^{5'UTR}$/QC69$^{C-NS2}$/JFH1 |
| | | 8 | 3.64 | 0.03 | |

In vitro transcribed RNAs of JFH1-based recombinants with genotype specific Core-NS2 and genotype-specific homotypic 5'UTR or heterotypic genotype 1a (H77) 5'UTR or heterotypic genotype 3a (S52) 5'UTR were transfected to Huh7.5 cells (data shown in FIG. 15). Supernatants were collected every 2-3 days post transfection. Infectivity titers were determined in supernatants from time points with peak infection (>=80% HCV infected cells). SEM, standard error mean of three replicates.
* The recombinants were from another transfection experiment, independent from that with Core-NS2 recombinants of the same genotype.

TABLE 5

Sequence analysis of 5'UTRs of first passage J6/JFH1 recombinants with 5'UTR of genotype 1-6.
The 5'UTR sequence of viral genomes collected at day 7 post infection (FIG. 21) were determined by 5'RACE. The first nucleotide G of 1a, 1b, 2b, 3a and 6a 5'UTR was changed to A, while the first nucleotide A of 2a, 4a and 5a 5'UTR was preserved.

| Virus | Genotype 5'UTR | C-NS2 | Mutation |
|---|---|---|---|
| H77$^{5'UTR}$/J6$^{C-NS2}$/JFH1 | 1a | 2a | G1A |
| J4$^{5'UTR}$/J6$^{C-NS2}$/JFH1 | 1b | 2a | G1A |
| J6/JFH | 2a | 2a | No |
| J6$^{5'UTR-NS2}$/JFH1 | 2a | 2a | No |
| J8$^{5'UTR}$/J6$^{C-NS2}$/JFH1 | 2b | 2a | G1A |
| S52$^{5'UTR}$/J6$^{C-NS2}$/JFH1 | 2b | 2a | G1A |
| ED43$^{5'UTR}$/J6$^{C-NS2}$/JFH1 | 3a | 2a | No |
| SA13$^{5'UTR}$/J6$^{C-NS2}$/JFH1 | 4a | 2a | No |
| HK6a$^{5'UTR}$/J6$^{C-NS2}$/JFH1 | 5a | 2a | G1A |

REFERENCES

Gottwein, J. M., T. K. Scheel, A. M. Hoegh, J. B. Lademann, J. Eugen-Olsen, G. Lisby, and J. Bukh, 2007, Robust hepatitis C genotype 3a cell culture releasing adapted intergenotypic 3a/2a (S52/JFH1) viruses: Gastroenterology, v. 133, no. 5, p. 1614-1626.

Gottwein J M, Scheel T K, Jensen T B, Lademann J B, Prentoe J C, Knudsen M L, Hoegh A M, Bukh J: Development and characterization of hepatitis C virus genotype 1-7 cell culture systems: role of CD81 and scavenger receptor class B type I and effect of antiviral drugs. Hepatology 2009; 49(2):364-377.

Jensen, T. B., J. M. Gottwein, T. K. Scheel, A. M. Hoegh, J. Eugen-Olsen, and J. Bukh, 2008, Highly efficient JFH1-based cell-culture system for hepatitis C virus genotype 5a: failure of homologous neutralizing-antibody treatment to control infection: J. Infect. Dis., v. 198, no. 12, p. 1756-1765.

Kim C S, Jung J H, Wakita T, Yoon S K, Jang S K. Monitoring the antiviral effect of alpha interferon on individual cells. J Virol 2007; 81:8814-8820.

Koutsoudakis G, Kaul A, Steinmann E, Kallis S, Lohmann V, Pietschmann T, Bartenschlager R. Characterization of the early steps of hepatitis C virus infection by using luciferase reporter viruses. J Virol 2006; 80:5308-5320.

Lindenbach B D, Meuleman P, Ploss A, Vanwolleghem T, Syder A J, McKeating J A, Lanford R E, Feinstone S M, Major M E, Leroux-Roels G, Rice C M: Cell culture-grown hepatitis C virus is infectious in vivo and can be recultured in vitro. Proc Natl Acad Sci USA 2006; 103(10):3805-3809.

Moradpour D, Evans M J, Gosert R, Yuan Z, Blum H E, Goff S P, Lindenbach B D, Rice C M. Insertion of green fluorescent protein into nonstructural protein 5A allows direct visualization of functional hepatitis C virus replication complexes. J Virol 2004; 78:7400-7409.

Schaller T, Appel N, Koutsoudakis G, Kallis S, Lohmann V, Pietschmann T, Bartenschlager R. Analysis of hepatitis C virus superinfection exclusion by using novel fluorochrome gene-tagged viral genomes. J Virol 2007; 81:4591-4603.

Scheel, T. K., J. M. Gottwein, T. B. Jensen, J. C. Prentoe, A. M. Hoegh, H. J. Alter, J. Eugen-Olsen, and J. Bukh, 2008, Development of JFH1-based cell culture systems for hepatitis C virus genotype 4a and evidence for cross-genotype neutralization: Proc. Natl. Acad. Sci. U.S.A., v. 105, no. 3, p. 997-1002.

Jones C T, Murray C L, Eastman D K, Tassello J, Rice C M. Hepatitis C Virus p7 and NS2 Proteins Are Essential for Production of Infectious Virus. J Virol 2007; 81:8374-8383.

Simmonds, P. et al., 2005, Consensus proposals for a unified system of nomenclature of hepatitis C virus genotypes: Hepatology, v. 42, no. 4, p. 962-973.

Tscherne D M, Jones C T, Evans M J, Lindenbach B D, McKeating J A, Rice C M. Time- and temperature-dependent activation of hepatitis C virus for low-pH-triggered entry. J Virol 2006; 80:1734-1741.

Yanagi, M., R. H. Purcell, S. U. Emerson, and J. Bukh, 1997, Transcripts from a single full-length cDNA clone of hepatitis C virus are infectious when directly transfected into the liver of a chimpanzee: Proc. Natl. Acad. Sci. U.S.A., v. 94, no. 16, p. 8738-8743.

Yanagi, M., R. H. Purcell, S. U. Emerson, and J. Bukh, 1999, Hepatitis C virus: an infectious molecular clone of a second major genotype (2a) and lack of viability of intertypic 1a and 2a chimeras: Virology., v. 262, no. 1, p. 250-263.

| Sequence listing | | |
|---|---|---|
| Sequence ID | Nucleotide (NT)/amino acid(AA) | Name |
| SEQ ID NO: 1 | Nucleotide | H77/JFH1-EGFPΔ (1a/2a) |
| SEQ ID NO: 2 | Nucleotide | J4/JFH1-EGFPΔ (1b/2a) |
| SEQ ID NO: 3 | Nucleotide | J6/JFH1-EGFPΔ (2a/2a) |
| SEQ ID NO: 4 | Nucleotide | J8/JFH1-EGFPΔ (2b/2a) |
| SEQ ID NO: 5 | Nucleotide | S52/JFH1-EGFPΔ (3a/2a) |
| SEQ ID NO: 6 | Nucleotide | ED43/JFH1-EGFPΔ (4a/2a) |
| SEQ ID NO: 7 | Nucleotide | SA13/JFH1-EGFPΔ (5a/2a) |
| SEQ ID NO: 8 | Nucleotide | HK6a/JFH$_1$-EGFPΔ (6a/2a) |
| SEQ ID NO: 9 | Nucleotide | QC69/JFH1-EGFPΔ (7a/2a) |
| SEQ ID NO: 10 | Nucleotide | J6/JFH1-hRlucΔ (2a/2a) |
| SEQ ID NO: 11 | Amino acid | H77/JFH1-EGFPΔ (1a/2a) |
| SEQ ID NO: 12 | Amino acid | J4/JFH1-EGFPΔ (1b/2a) |
| SEQ ID NO: 13 | Amino acid | J6/JFH1-EGFPΔ (2a/2a) |
| SEQ ID NO: 14 | Amino acid | J8/JFH1-EGFPΔ (2b/2a) |
| SEQ ID NO: 15 | Amino acid | S52/JFH1-EGFPΔ (3a/2a) |
| SEQ ID NO: 16 | Amino acid | ED43/JFH1-EGFPΔ (4a/2a) |
| SEQ ID NO: 17 | Amino acid | SA13/JFH1-EGFPΔ (5a/2a) |
| SEQ ID NO: 18 | Amino acid | HK6a/JFH$_1$-EGFPΔ (6a/2a) |
| SEQ ID NO: 19 | Amino acid | QC69/JFH1-EGFPΔ (7a/2a) |
| SEQ ID NO: 20 | Amino acid | J6/JFH1-hRlucΔ (2a/2a) |
| SEQ ID NO: 21 | Nucleotide | H77$^{5'UTR\text{-}NS2}$/JFH1$_{T2701C,\ A4081T}$ (1a/2a) |
| SEQ ID NO: 22 | Nucleotide | J4$^{5'UTR\text{-}NS2}$/JFH1$_{T2997C,\ A4828T}$ (1b/2a) |
| SEQ ID NO: 23 | Nucleotide | J6$^{5'UTR\text{-}NS2}$/JFH1 (2a/2a) |
| SEQ ID NO: 24 | Nucleotide | J8$^{5'UTR\text{-}NS2}$/JFH1 (2b/2a) |
| SEQ ID NO: 25 | Nucleotide | S52$^{5'UTR\text{-}NS2}$/JFH1$_{T2717G,\ A4549C}$ (3a/2a) |
| SEQ ID NO: 26 | Nucleotide | ED43$^{5'UTR\text{-}NS2}$/JFH1$_{A2819G,\ A3269T}$ (4a/2a) |
| SEQ ID NO: 27 | Nucleotide | SA13$^{5'UTR\text{-}NS2}$/JFH1$_{C3404G,\ A3695G}$ (5a/2a) |
| SEQ ID NO: 28 | Nucleotide | HK6a$^{5'UTR\text{-}NS2}$/JFH1$_{T1391C,\ A1592C}$ (6a/2a) |
| SEQ ID NO: 29 | Amino acid | H77$^{5'UTR\text{-}NS2}$/JFH1$_{T2701C,\ A4081T}$ (1a/2a) |
| SEQ ID NO: 30 | Amino acid | J4$^{5'UTR\text{-}NS2}$/JFH1$_{T2997C,\ A4828T}$ (1b/2a) |
| SEQ ID NO: 31 | Amino acid | J6$^{5'UTR\text{-}NS2}$/JFH1 (2a/2a) |
| SEQ ID NO: 32 | Amino acid | J8$^{5'UTR\text{-}NS2}$/JFH1 (2b/2a) |
| SEQ ID NO: 33 | Amino acid | S52$^{5'UTR\text{-}NS2}$/JFH1$_{T2717G,\ A4549C}$ (3a/2a) |
| SEQ ID NO: 34 | Amino acid | ED43$^{5'UTR\text{-}NS2}$/JFH1$_{A2819G,\ A3269T}$ (4a/2a) |
| SEQ ID NO: 35 | Amino acid | SA13$^{5'UTR\text{-}NS2}$/JFH1$_{C3404G,\ A3695G}$ (5a/2a) |
| SEQ ID NO: 36 | Amino acid | HK6a$^{5'UTR\text{-}NS2}$/JFH1$_{T1391C,\ A1592C}$ (6a/2a) |
| SEQ ID NO: 37 | Nucleotide | H77$^{5'UTR}$/J4$^{C\text{-}NS2}$/JFH1$_{T2997C,\ A4828T}$ (1a/1b/2a) |
| SEQ ID NO: 38 | Nucleotide | H77$^{5'UTR}$/J6$^{C\text{-}NS2}$/JFH1 (1a/2a/2a) |
| SEQ ID NO: 39 | Nucleotide | H77$^{5'UTR}$/J8$^{C\text{-}NS2}$/JFH1 (1a/2b/2a) |
| SEQ ID NO: 40 | Nucleotide | H77$^{5'UTR}$/S52$^{C\text{-}NS2}$/JFH1$_{T2719G,\ A4551C}$ (1a/3a/2a) |
| SEQ ID NO: 41 | Nucleotide | H77$^{5'UTR}$/ED43$^{C\text{-}NS2}$/JFH1$_{A2820G,\ A3270T}$ (1a/4a/2a) |
| SEQ ID NO: 42 | Nucleotide | H77$^{5'UTR}$/SA13$^{C\text{-}NS2}$/JFH1$_{C3406G,\ A3697G}$ (1a/5a/2a) |
| SEQ ID NO: 43 | Nucleotide | H77$^{5'UTR}$/HK6a$^{C\text{-}NS2}$/JFH1$_{T1390C,\ A1591C}$ (1a/6a/2a) |
| SEQ ID NO: 44 | Nucleotide | H77$^{5'UTR}$/QC69$^{C\text{-}NS2}$/JFH1 (1a/7a/2a) |
| SEQ ID NO: 45 | Nucleotide | S52$^{5'UTR}$/H77$^{C\text{-}NS2}$/JFH1$_{T2666C,\ A4079T}$ (3a/1a/2a) |
| SEQ ID NO: 46 | Nucleotide | S52$^{5'UTR}$/J4$^{C\text{-}NS2}$/JFH1$_{T2995C,\ A4826T}$ (3a/1b/2a) |
| SEQ ID NO: 47 | Nucleotide | S52$^{5'UTR}$/J6$^{C\text{-}NS2}$/JFH1 (3a/2a/2a) |
| SEQ ID NO: 48 | Nucleotide | S52$^{5'UTR}$/J8$^{C\text{-}NS2}$/JFH1 (3a/2b/2a) |
| SEQ ID NO: 49 | Nucleotide | S52$^{5'UTR}$/ED43$^{C\text{-}NS2}$/JFH1$_{A2818G,\ A3268T}$ (3a/4a/2a) |
| SEQ ID NO: 50 | Nucleotide | S52$^{5'UTR}$/SA13$^{C\text{-}NS2}$/JFH1$_{C3404G,\ A3695G}$ (3a/5a/2a) |
| SEQ ID NO: 51 | Nucleotide | S52$^{5'UTR}$/HK6a$^{C\text{-}NS2}$/JFH1$_{T1388C,\ A1589C}$ (3a/6a/2a) |
| SEQ ID NO: 52 | Nucleotide | S52$^{5'UTR}$/QC69$^{C\text{-}NS2}$/JFH1 (3a/7a/2a) |
| SEQ ID NO: 53 | Amino acid | H77$^{5'UTR}$/J4$^{C\text{-}NS2}$/JFH1$_{T2997C,\ A4828T}$ (1a/1b/2a) |
| SEQ ID NO: 54 | Amino acid | H77$^{5'UTR}$/J6$^{C\text{-}NS2}$/JFH1 (1a/2a/2a) |
| SEQ ID NO: 55 | Amino acid | H77$^{5'UTR}$/J8$^{C\text{-}NS2}$/JFH1 (1a/2b/2a) |
| SEQ ID NO: 56 | Amino acid | H77$^{5'UTR}$/S52$^{C\text{-}NS2}$/JFH1$_{T2719G,\ A4551C}$ (1a/3a/2a) |
| SEQ ID NO: 57 | Amino acid | H77$^{5'UTR}$/ED43$^{C\text{-}NS2}$/JFH1$_{A2820G,\ A3270T}$ (1a/4a/2a) |
| SEQ ID NO: 58 | Amino acid | H77$^{5'UTR}$/SA13$^{C\text{-}NS2}$/JFH1$_{C3406G,\ A3697G}$ (1a/5a/2a) |
| SEQ ID NO: 59 | Amino acid | H77$^{5'UTR}$/HK6a$^{C\text{-}NS2}$/JFH1$_{T1390C,\ A1591C}$ (1a/6a/2a) |
| SEQ ID NO: 60 | Amino acid | H77$^{5'UTR}$/QC69$^{C\text{-}NS2}$/JFH1 (1a/7a/2a) |
| SEQ ID NO: 61 | Amino acid | S52$^{5'UTR}$/H77$^{C\text{-}NS2}$/JFH1$_{T2699C,\ A4079T}$ (3a/1a/2a) |
| SEQ ID NO: 62 | Amino acid | S52$^{5'UTR}$/J4$^{C\text{-}NS2}$/JFH1$_{T2995C,\ A4826T}$ (3a/1b/2a) |
| SEQ ID NO: 63 | Amino acid | S52$^{5'UTR}$/J6$^{C\text{-}NS2}$/JFH1 (3a/2a/2a) |
| SEQ ID NO: 64 | Amino acid | S52$^{5'UTR}$/J8$^{C\text{-}NS2}$/JFH1 (3a/2b/2a) |
| SEQ ID NO: 65 | Amino acid | S52$^{5'UTR}$/ED43$^{C\text{-}NS2}$/JFH1$_{A2818G,\ A3268T}$ (3a/4a/2a) |
| SEQ ID NO: 66 | Amino acid | S52$^{5'UTR}$/SA13$^{C\text{-}NS2}$/JFH1$_{C3404G,\ A3695G}$ (3a/5a/2a) |

-continued

| Sequence ID | Nucleotide (NT)/amino acid(AA) | Name |
|---|---|---|
| SEQ ID NO: 67 | Amino acid | S52$^{5'UTR}$/HK6a$^{C-NS2}$/JFH1$_{T1388C, A1589C}$ (3a/6a/2a) |
| SEQ ID NO: 68 | Amino acid | S52$^{5'UTR}$/QC69$^{C-NS2}$/JFH1 (3a/7a/2a) |
| SEQ ID NO: 69 | Nucleotide | H77/JFH(T2700C, A4080T)-EGFPΔ (1a/2a) |
| SEQ ID NO: 70 | Nucleotide | TN/JFH1(T2700C, A4080T)-EGFPΔ (1a/2a) |
| SEQ ID NO: 71 | Nucleotide | J4/JFH1(T2996C, A4827T)-EGFPΔ (1b/2a) |
| SEQ ID NO: 72 | Nucleotide | S52/JFH1(T2718G, A4550C)-EGFPΔ (3a/2a) |
| SEQ ID NO: 73 | Nucleotide | S52/JFH1(A4550C)-EGFPΔ (3a/2a) |
| SEQ ID NO: 74 | Nucleotide | ED43/JFH1(A2819G, A3269T)-EGFPΔ (4a/2a) |
| SEQ ID NO: 75 | Nucleotide | SA13/JFH1(C3405G, A3696G)-EGFPΔ (5a/2a) |
| SEQ ID NO: 76 | Nucleotide | HK6a/JFH1(T1389C, A1590C)-EGFPΔ (6a/2a) |
| SEQ ID NO: 77 | Nucleotide | QC69/JFH1(T2985C, C9018T)-EGFPΔ (7a/2a) |
| SEQ ID NO: 78 | Nucleotide | J6/JFH1-CherryΔ (2a/2a) |
| SEQ ID NO: 79 | Nucleotide | J6/JFH1-DSRedΔ (2a/2a) |
| SEQ ID NO: 80 | Nucleotide | H77/JFH1(T2700C, A4080T)-hRlucΔ (1a/2a) |
| SEQ ID NO: 81 | Nucleotide | TN/JFH1(T2700C, A4080T)-hRlucΔ (1a/2a) |
| SEQ ID NO: 82 | Nucleotide | J4/JFH1(T2996C, A4827T)-hRlucΔ (1b/2a) |
| SEQ ID NO: 83 | Nucleotide | J8/JFH1-hRlucΔ (2b/2a) |
| SEQ ID NO: 84 | Nucleotide | S52/JFH (T2718G, A4550C)-hRlucΔ (3a/2a) |
| SEQ ID NO: 85 | Nucleotide | ED43/JFH1(A2819G, A3269T)-hRlucΔ (4a/2a) |
| SEQ ID NO: 86 | Nucleotide | SA13/JFH1(C3405G, A3696G)-hRlucΔ (5a/2a) |
| SEQ ID NO: 87 | Nucleotide | HK6a/JFH1(T1389C, A1590C)-hRlucΔ (6a/2a) |
| SEQ ID NO: 88 | Nucleotide | QC69/JFH1(T2985C, C9234T)-hRlucΔ (7a/2a) |
| SEQ ID NO: 89 | Amino acid | H77/JFH(T2700C, A4080T)-EGFPΔ (1a/2a) |
| SEQ ID NO: 90 | Amino acid | pTN/JFH1(T2700C, A4080T)-EGFPΔ (1a/2a) |
| SEQ ID NO: 91 | Amino acid | J4/JFH1(T2996C, A4827T)-EGFPΔ (1b/2a) |
| SEQ ID NO: 92 | Amino acid | S52/JFH1(T2718G, A4550C)-EGFPΔ (3a/2a) |
| SEQ ID NO: 93 | Amino acid | S52/JFH1(A4550C)-EGFPΔ (3a/2a) |
| SEQ ID NO: 94 | Amino acid | ED43/JFH1(A2819G, A3269T)-EGFPΔ (4a/2a) |
| SEQ ID NO: 95 | Amino acid | SA13/JFH1(C3405G, A3696G)-EGFPΔ (5a/2a) |
| SEQ ID NO: 96 | Amino acid | HK6a/JFH1(T1389C, A1590C)-EGFPΔ (6a/2a) |
| SEQ ID NO: 97 | Amino acid | QC69/JFH1(T2985C, C9018T)-EGFPΔ (7a/2a) |
| SEQ ID NO: 98 | Amino acid | J6/JFH1-CherryΔ (2a/2a) |
| SEQ ID NO: 99 | Amino acid | J6/JFH1-DSRedΔ (2a/2a) |
| SEQ ID NO: 100 | Amino acid | H77/JFH1(T2700C, A4080T)-hRlucΔ (1a/2a) |
| SEQ ID NO: 101 | Amino acid | TN/JFH1(T2700C, A4080T)-hRlucΔ (1a/2a) |
| SEQ ID NO: 102 | Amino acid | J4/JFH1(T2996C, A4827T)-hRlucΔ (1b/2a) |
| SEQ ID NO: 103 | Amino acid | J8/JFH1-hRlucΔ (2b/2a) |
| SEQ ID NO: 104 | Amino acid | S52/JFH (T2718G, A4550C)-hRlucΔ (3a/2a) |
| SEQ ID NO: 105 | Amino acid | ED43/JFH1(A2819G, A3269T)-hRlucΔ (4a/2a) |
| SEQ ID NO: 106 | Amino acid | SA13/JFH1(C3405G, A3696G)-hRlucΔ (5a/2a) |
| SEQ ID NO: 107 | Amino acid | HK6a/JFH1(T1389C, A1590C)-hRlucΔ (6a/2a) |
| SEQ ID NO: 108 | Amino acid | QC69/JFH1(T2985C, C9234T)-hRlucΔ (7a/2a) |
| SEQ ID NO: 109 | Nucleotide | J4$^{5'UTR}$/J6$^{C-NS2}$/JFH1 (1b/2a/2a) |
| SEQ ID NO: 110 | Nucleotide | J8$^{5'UTR}$/J6$^{C-NS2}$/JFH1 (2b/2a/2a) |
| SEQ ID NO: 111 | Nucleotide | ED43$^{5'UTR}$/J6$^{C-NS2}$/JFH1 (4a/2a/2a) |
| SEQ ID NO: 112 | Nucleotide | SA13$^{5'UTR}$/J6$^{C-NS2}$/JFH1 (5a/2a/2a) |
| SEQ ID NO: 113 | Nucleotide | HK6a$^{5'UTR}$/J6$^{C-NS2}$/JFH1 (6a/2a/2a) |
| SEQ ID NO: 114 | Amino acid | J4$^{5'UTR}$/J6$^{C-NS2}$/JFH1 (1b/2a/2a) |
| SEQ ID NO: 115 | Amino acid | J8$^{5'UTR}$/J6$^{C-NS2}$/JFH1 (2b/2a/2a) |
| SEQ ID NO: 116 | Amino acid | ED43$^{5'UTR}$/J6$^{C-NS2}$/JFH1 (4a/2a/2a) |
| SEQ ID NO: 117 | Amino acid | SA13$^{5'UTR}$/J6$^{C-NS2}$/JFH1 (5a/2a/2a) |
| SEQ ID NO: 118 | Amino acid | HK6a$^{5'UTR}$/J6$^{C-NS2}$/JFH1 (6a/2a/2a) |
| SEQ ID NO: 119 | Nucleotide | TN/JFH1-EGFPΔ (1a/2a) |
| SEQ ID NO: 120 | Amino acid | TN/JFH1-EGFPΔ (1a/2a) |
| SEQ ID NO: 121 | Nucleotide | H77/JFH1-hRlucΔ (1a/2a) |
| SEQ ID NO: 122 | Nucleotide | TN/JFH1-hRlucΔ (1a/2a) |
| SEQ ID NO: 123 | Nucleotide | J4/JFH1-hRlucΔ (1b/2a) |
| SEQ ID NO: 124 | Nucleotide | S52/JFH1-hRlucΔ (3a/2a) |
| SEQ ID NO: 125 | Nucleotide | ED43/JFH1-hRlucΔ (4a/2a) |
| SEQ ID NO: 126 | Nucleotide | SA13/JFH1-hRlucΔ (5a/2a) |
| SEQ ID NO: 127 | Nucleotide | HK6a/JFH1-hRlucΔ (6a/2a) |
| SEQ ID NO: 128 | Nucleotide | QC69/JFH1-hRlucΔ (7a/2a) |
| SEQ ID NO: 129 | Amino acid | H77/JFH1-hRlucΔ (1a/2a) |
| SEQ ID NO: 130 | Amino acid | TN/JFH1-hRlucΔ (1a/2a) |
| SEQ ID NO: 131 | Amino acid | J4/JFH1-hRlucΔ (1b/2a) |
| SEQ ID NO: 132 | Amino acid | S52/JFH1-hRlucΔ (3a/2a) |
| SEQ ID NO: 133 | Amino acid | ED43/JFH1-hRlucΔ (4a/2a) |
| SEQ ID NO: 134 | Amino acid | SA13/JFH1-hRlucΔ (5a/2a) |
| SEQ ID NO: 135 | Amino acid | HK6a/JFH1-hRlucΔ (6a/2a) |
| SEQ ID NO: 136 | Amino acid | QC69/JFH1-hRlucΔ (7a/2a) |

SEQUENCE LISTING (136 sequences)

SEQ ID NO: 1 - DNA, 10263 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacgaatcctaaacctcaaagaaaaaccaaacgtaacaccaaccgtcgcccacaggacgtcaagttcccgggtggcggtcagatcgttggtggagtttacttgttgccgcgcaggggccctagattgggtgtgcgcgcgacgaggaagacttccgagcggtcgcaacctcgaggtagacgtcagcctatccccaaggcacgtcggcccgagggcaggacctgggctcagcccgggtacccttggcccctctatggcaatgagggttgcgggtgggcgggatggctcctgtctccccgtggctctcggcctagctggggccccacagacccccggcgtaggtcgcgcaatttgggtaaggtcatcgatacccttacgtgcggcttcgccgacctcatggggtacataccgctcgtcggcgcccctcttggaggcgctgccagggccctggcgcatggcgtccgggttctggaagacggcgtgaactatgcaacagggaaccttcctggttgctctttctctatcttccttctggccctgctctcttgcctgactgtgcccgcttcagcctaccaagtgcgcaattcctcggggctttaccatgtcaccaatgattgccctaactcgagtattgtgtacgaggcggccgatgccatcctgcacactccggggtgtgtcccttgcgttcgcgagggtaacgcctcgaggtgttgggtggcggtgacccccacggtggccaccagggacggcaaactccccacaacgcagcttcgacgtcatatcgatctgcttgtcgggagcgccaccctctgctcggccctctacgtgggggacctgtgcgggtctgtctttcttgttggtcaactgtttaccttctctcccaggcgccactggacgacgcaagactgcaattgttctatctatcccggccatataacgggtcatcgcatggcatgggatatgatgatgaactggtcccctacggcagcgttggtggtagctcagctgctccggatcccacaagccatcatggacatgatcgctggtgctcactggggagtcctggcgggcatagcgtatttctccatggtggggaactgggcgaaggtcctggtagtgctgctgctatttgccggcgtcgacgcggaaacccacgtcaccgggggaaatgccggccgcaccacggctgggcttgttggtctccttacaccaggcgccaagcagaacatccaactgatcaacaccaacggcagttggcacatcaatagcacggccttgaattgcaatgaaagccttaacaccggctggttagcagggctcttctatcaacacaaattcaactcttcaggctgtcctgagaggttggccagctgccgacgccttaccgattttgcccagggctggggtcctatcagttatgccaacggaagcggcctcgacgaacgcccctactgctggcactaccctccaagaccttgtggcattgtgcccgcaaagagcgtgtgtggcccggtatattgcttcactcccagccccgtggtggtgggaacgaccgacaggtcgggcgcgcctacctacagctggggtgcaaatgatacggatgtcttcgtccttaacaacaccaggccaccgctgggcaattggttcggttgtacctggatgaactcaactggattcaccaaagtgtgcggagcgcccccttgtgtcatcggaggggtgggcaacaacaccttgctctgccccactgattgcttccgcaaacatccggaagccacatactctcggtgcggctccggtccctggattacacccaggtgcatggtcgactacccgtataggctttggcactatccttgtaccatcaattacaccatattcaaagtcaggatgtacgtgggaggggtcgagcacaggctggaagcggcctgcaactggacgcggggcgaacgctgtgatctggaagacagggacaggtccgagctcagcccgttgctgctgtccaccacacagtggcaggtccttccgtgttctttcacgaccctgccagccttgtccaccggcctcatccacctccaccagaacattgtggacgtgcagtacttgtacggggtagggtcaagcatcgcgtcctgggccattaagtgggagtacgtcgttctcctgttccttctgcttgcagacgcgcgcgtctgctcctgcttgtggatgatgttactcatatcccaagcggaggcggctttggagaacctcgtaatactcaatgcagcatccctggccgggacgcacggtcttgtgtccttcctcgtgttcttctgctttgcgtggtatctgaagggtaggtgggtgcccggagcggtctacgccctctacgggatgtggcctctcctcctgctcctgctggcgttgcctcagcgggcatacgcactggacacggaggtggccgcgtcgtgtggcggcgttgttcttgtcgggttaatggcgctgactctgtcgccatattacaagcgctatatcagctggtgcatgtggtggcttcagtattttctgaccagagtagaagcgcaactgcacgtgtgggttccccccctcaacgtccggggggggcgcgatgccgtcatcttactcatgtgtgtagtacacccgaccctggtatttgacatcaccaaactactcctggccatcttcggacccctttggattcttcaagccagtttgcttaaagtcccctacttcgtgcgcgttcaaggccttctccggatctgcgcgctagcgcggaagatagccggaggtcattacgtgcaaatggccatcatcaagttaggggcgcttactggcacctatgtgtataaccatctcacccctcttcgagactgggcgcacaacggcctgcgagatctggccgtggctgtggaaccagtcgtcttctcccgaatggagaccaagctcatcacgtggggggcagataccgccgcgtgcggtgacatcatcaacggcttgcccgtctctgcccgtaggggccaggagatactgcttgggccagccgacggaatggtctccaaggggtggaggttgctggctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 2 - DNA, 10263 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacgaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaaggcttccgagcggtcgcaacctcgtggaaggcgacaacctatcccaaaggctcgccgacccgagggcagggcctgggctcagcccgggtacccttggcccctctatggcaatgagggcctggggtgggcaggatggctcctgtcaccccgcggctcccggcctagttggggccccacggacccccggcgtaggtcgcgtaacttgggtaaggtcatcgatacccttacatgcggcttcgccgatctcatggggtacattccgctcgtcggcgcccccctagggggcgctgccagggccttggcacacggtgtccgggttctggaggacggcgtgaactatgcaacagggaacttgcccggttgctctttctctatcttcctcttggctctgctgtcctgtttgaccatcccagcttccgcttatgaagtgcgcaacgtgtccgggatataccatgtcacgaacgactgctccaactcaagcattgtgtatgaggcagcggacgtgatcatgcatactcccgggtgcgtgccctgtgttcaggagggtaacagctcccgttgctgggtagcgctcactcccacgctcgcggccaggaatgccagcgtccccactacgacaatacgacgccacgtcgacttgctcgttgggacggctgctttctgctccgctatgtacgtgggggatctctgcggatctattttcctcgtctcccagctgttcaccttctcgcctcgccggcatgagacagtgcaggactgcaactgctcaatctatcccggccatgtatcaggtcaccgcatggcttgggatatgatgatgaactggtcacctacaacagccctagtggtgtcgcagttgctccggatcccacaagctgtcgtggacatggtggcgggggcccactggggagtcctggcgggccttgcctactattccatggtagggaactgggctaaggttctgattgtggcgctactctttgccggcgttgacggggagacccacacgacggggagggtggccggccacaccacctccgggttcacgtcccttttctcatctggggcgtctcagaaaatccagcttgtgaataccaacggcagctggcacatcaacaggactgccctaaattgcaatgactccctccaaactgggttctttgccgcgctgttttacgcacacaagttcaactcgtccgggtgcccggagcgcatggccagctgccgccccattgactggttcgcccaggggtggggccccatcacctatactaagcctaacagctcggatcagaggccttattgctggcattacgcgcctcgaccgtgtggtgtcgtacccgcgtcgcaggtgtgtggtccagtgtattgtttcaccccaagccctgttgtggtggggaccaccgatcgttccggtgtccctacgtatagctggggggagaatgagacagacgtgatgctcctcaacaacacgcgtccgccacaaggcaactggttcggctgtacatggatgaatagtactgggttcactaagacgtgcggaggtcccccgtgtaacatcgggggggtcggtaaccgcaccttgatctgccccacggactgcttccggaagcaccccgaggctacttacacaaaatgtggctcggggccctggttgacacctaggtgcctagtagactacccatacaggctttggcactacccctgcactctcaatttttccatctttaaggttaggatgtatgtggggggcgtggagcacaggctcaatgccgcatgcaattggactcgaggagagcgctgtaacttggaggacagggataggtcagaactcagcccgctgctgctgtctacaacagagtggcagatactgccctgtgctttcaccaccctaccggctttatccactggtttgatccatctccatcagaacatcgtggacgtgcaatacctgtacggtgtagggtcagcgtttgtctcctttgcaatcaaatgggagtacatcctgttgcttttccttctcctggcagacgcgcgcgtgtgtgcctgcttgtggatgatgctgctgatagcccaggctgaggccgccttagagaacttggtggtcctcaatgcggcgtccgtggccggagcgcatggtattctctcctttcttgtgttcttctgcgccgcctggtacattaagggcaggctggctcctggggcggcgtatgctttttatggcgtatggccgctgctcctgctcctactggcgttaccaccacgagcttacgccttggaccgggagatggctgcatcgtgcgggggtgcggttcttgtaggtctggtattcttgaccttgtcaccatactacaaagtgtttctcactaggctcatatggtggttacaatactttatcaccagagccgaggcgcacatgcaagtgtgggtcccccccctcaacgttcggggaggccgcgatgccatcatcctcctcacgtgtgcggttcatccagagttaatttttgacatcaccaaactcctgctcgccatactcggcccgctcatggtgctccaggctggcataacgagagtgccgtacttcgtgcgcgctcaagggctcattcgtgcatgcatgttagtgcgaaaagtcgccgggggtcattatgtccaaatggtcttcatgaagctgggcgcgctgacaggtacgtacgtttataaccatcttaccccactgcgggactgggcccacgcgggcctacgagaccttgcggtggcggtagagcccgtcgtcttctccgccatggagaccaaggtcatcacctggggagcagacaccgctgcgtgtggggacatcatcttgggtctacccgtctccgcccgaagggggaaggagatatttttgggaccggctgatagtctcgaagggcaagggtggcgactccttgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 3 - DNA, 10275 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 4 - DNA, 10275 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaaccaaaagaaacacaaaccgccgcccacaggacgttaagttcccgggtggcggtcagatcgttggcggagtttacttgctgccgcgcaggggccccaggttgggtgtgcgcgcgacaaggaagacttctgagcgatcccagccgcgtggacgacgccagcccatcccgaaagatcggcgctccaccggcaagtcctggggaaagccaggatatccttggcccctgtacggaaacgagggttgcggctgggcgggttggctcctgtccccccgcgggtctcgtcctacttggggccccaccgacccccggcatagatcacgcaatttgggcagagtcatcgataccattacgtgtggttttgccgacctcatggggtacatccctgtcgttggcgccccggttggaggcgtcgccagagctctggcacacggtgttagggtcctggaggacgggataaattacgcaacagggaatttacccggttgctctttttctatctttttgcttgctcttctgtcatgcgtcacagtgccagtgtctgcagtggaagtcaggaacattagttctagctactacgccactaatgattgctcaaacaacagcatcacctggcagctcactgacgcagttctccatcttcctggatgcgtcccatgtgagaatgataatggcaccttgcattgctggatacaagtaacacccaacgtggctgtgaaacaccgcggtgcgctcactcgtagcctgcgaacacacgtcgacatgatcgtaatggcagctacggcctgctcggccttgtatgtgggagatgtgtgcggggccgtgatgattctatcgcaggctttcatggtatcaccacaacgccacaacttcacccaagagtgcaactgttccatctaccaaggtcacatcaccggccatcgcatggcatgggacatgatgctgaactggtctccaactcttgccatgatcctcgcctacgccgctcgtgttcccgagatggtcctcgaaattattttcggcggccattggggtgtggtgtttggcttggcctacttctccatgcaaggagcgtgggccaaagtcattgccatcctccttcttgttgcgggagtggatgcaaccacctattccagcggccaggaagcgggtcgtaccgtcttggggttcactaacctctttacttctggtgccaagcagaacctctatttaatcaacaccaatggcagctggcacataaaccggactgccctcaattgcaatgacagcttacagacgggtttcatggcttccctgttttacacccacaggttcaacagctctggctgccccgagcgcttgtcttcctgccgcgggctggacgattttcgcatcggctggggaaccttggaatacgaaacccacgtcaccaacgatgaggacatgaggccgtactgctggcattaccctccgaggccttgcggcatcgtcccggctagaacggtttgcggaccggtctattgtttcacccctagccctgttgtcgtgggcaccactgacaagcagggcgtacccacctacacctggggggaaaacgagaccgatgtcttcctgctgaatagcacaagacccccgcgaggagcttggttcggctgcacttggatgaacgggactgggttcactaagacatgcggtgcaccaccttgccgcattaggaaagactacaacagcactatcgatttattgtgccccacagactgttttaggaagcaccccgatgctacctatcttaagtgtggagcagggccttggttaactcccaggtgcctggtagactacccttatagactgtggcattatccgtgcactgtaaacttcaccatctttaaggcgcggatgtatgtaggaggggtggagcatcgattctccgcagcatgcaacttcacgcgcggagatcgctgcagactggaagatagggataggggtcagcagagtccactgctgcattccactactgagtgggcggtgctcccatgctccttctctgacctaccagcactatccactggcctattgcacctccaccaaaacatcgtggacgtgcagtacctttacggactttctccggctctgacaagatacatcgtgaagtgggagtgggtgatcctccttttcttgttgttggcagacgccaggatctgtgcatgcctttggatgctcatcatactgggccaagccgaagcggcgcttgagaagctcatcatcttgcactccgctagtgctgctagtgccaatggtccgctgtggtttttcatcttctttacagcggcctggtacttaaagggcagggtggtccccgtggccacgtactctgttctcggcttatggtccttcctcctcctagtcctggccttaccacagcaggcttatgccttggacgctgctgaacaaggggaactggggctggccatattagtaattatatccatctttactcttaccccagcatacaagatcctcctgagccgttcagtgtggtggctgtcctacatgctggtcttggccgaggcccagattcagcaatgggttccccccctggaggtccgaggggggcgtgacggaatcatctgggtggctgtcattctacacccacgccttgtgtttgaggtcacgaaatggttgttagcaatcctggggcctgcctacctccttaaagcgtctctgctacggataccgtactttgtgagggcccacgctttgctacgagtgtgtaccctggtgaaacacctcgcgggggctaggtacatccagatgctgttgatcaccataggcagatggaccggcacttacatctacgaccacctctcccctttatcaacttgggcggcccagggtttgcgggacctggcaatcgccgtggagcctgtggtgttcagcccaatggagaagaaggtcattgtgtggggggctgagacagtggcgtgtggagacatcctgcatggcctcccggtctccgcgaggctaggtagggaggttctgctcggccctgccgacggctacacctccaaggggtggaagctcctagctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 5 - DNA, 10281 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacacttcctaaacctcaaagaaaaaccaaaagaaacaccatccgtcgcccacaggacgttaagttcccgggtggcggacagatcgttggtggagtatacgtgttgccgcgcaggggcccacgattgggtgtgcgcgcgacgcgtaaaacttctgaacggtcacagcctcgcggacgacgacagcctatccccaaggcgcgtcggagcgaaggccggtcctgggctcagcccgggtacccttggcccctctatggtaatgagggctgcgggtgggcagggtggctcctgtccccgcgcggctcccgtccatcttggggcccaaacgacccccggcggaggtcccgcaatttgggtaaagtcatcgatacccttacgtgcggattcgccgacctcatggggtacatcccgctcgtcggcgctcccgtaggaggcgtcgcaagagccctcgcgcatggcgtgagggcccttgaagacgggataaattttgcaacagggaacttgcccggttgctccttttctatcttccttcttgctctgttctcctgcttagttcatcctgcagctagtcttgagtggcggaatacgtctggcctctatgtccttaccaacgactgttccaatagcagtattgtgtatgaggccgatgacgtcattctgcacacacccggctgtgtaccttgtgttcaggacgacaatacatccacgtgctggaccccagtgacacctacggtggcagtcaggtacgtcggagcaaccaccgcttcgatacgcagtcatgtggacctattagtgggcgcggccacgctgtgctctgcgctctatgtgggtgatatgtgtggggccgtctttctcgtgggacaagccttcacgttcagacctcgtcgccatcaaacggtccagacctgtaactgctcgctgtacccaggccatgtttcaggacatcgaatggcttgggatatgatgatgaattggtcccccgctgtgggtatggtggtggcgcacatcctgcgattgccccagaccttgtttgacatactggccggggcccattggggcatcttggcgggcctagcctattattctatgcagggcaactgggccaaggtcgctattgtcatgattatgttttcaggggtcgatgctgaaacatatgtcaccggtggcagtgtagctcatagtgccagagggttaactagcctttttagtatgggcgccaagcagaaactgcaattggtcaacaccaatggctcgtggcacatcaacagtactgccctgaactgcaatgagtccataaacaccgggttcatagctgggttgttttattaccataagttcaactctactggatgtcctcaaaggcttagcagctgcaagcccatcatttccttcaggcaggggtggggccccttgacagatgctaacatcaccggtccttctgatgatagaccgtattgctggcactacgcacctagaccttgtagtgttgtcccggcatcaagtgtctgcggccctgtgtactgcttcacaccatcgccagtggtcgtaggcactactgatatcaaaggcaagccgacctacaactggggtgagaatgagacagatgtgttcctgctggagtccctgcggcctcccagtggccggtggtttggatgcgcgtggatgaactccacggggttcctcaagacgtgtggagctcccccttgtaacatctatgggggtgagggggatcccgaaaatgagacagacctcttctgccccaccgactgcttcaggaaacatcctgaggccacatacagccggtgtggtgcggggccctggttgacacctcgctgcatggtcgactatccataccggctttggcattacccatgtacagtcaatttcacattgttcaaggtgaggatgtttgtgggcggatttgaacaccggtttaccgccgcttgtaactggaccaggggggagcgctgcaatatcgaggatcgtgatcgcagcgagcaacatccgctgctgcattcaacaactgagcttgctatactgccttgctctttcacgcccatgcctgcattgtcaacaggtctaatacacctccaccaaaatatcgtggatgtccaatacctttatggtgttggatctgacatggtgggatgggcgctgaaatgggagttcgtcatcctcgttttcctcctcctggcagacgcacgcgtgtgcgttgccctttggctgatgctgatggtatcacaagcagaagcagccttggagaaccttgtcacgctgaacgccgtcgctgctgctgggacacatggtattggttggtacctggtagccttttgcgcggcgtggtacgtgcggggtaaacttgtcccgctgacgatctacggcctgacgggtctttggtccctagcattgcttgtcctcttgctcccccaacgggcgtatgcttggtcgggtgaagacagcgctactctcggcgctggggtcttggccctcttcggcttctttaccttatcaccctggtacaagcattggatcggccgcctcatgtggtggaaccagtacactatatgtagatgcgaggccgcccttcaagtgtgggtcccccccttacttgcacgcgggagtagggacggtgtcatcctgctaacaagcttgctttatccatccttaatttttgacatcactaagctgctgatagcagtaataggcccattatacttaatacaggctgccatcactaccaccccctactttgtgcgcgcacatgtactggtccgcctttgcatgctcgtgcgctccgtgatggggggaaagtacttccagatggccatactgagcattggcagatggttcaacacctacctatatgaccacctagcgccaatgcaacattgggccgcagctggcctcaaagacctagcagtggccactgaacctgtaatatttagtcccatggaaattaaggtcatcacctggggcgcggacacagcggcttgcggagatattctttgcgggctgccggtctccgcgcgattaggccgtgaggtattgttgggacctgctgatgattatcgggaaatgggttggcgtctgttggctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 6 - DNA, 10263 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacgaatcctaaacctcaaagaaaaaccaaacgtaacaccaaccgccgcccaatggacgttaagttcccgggtggtggccagatcgttggcggagtttacttgttgccgcgcaggggccccagattgggtgtgcgcgcgactcggaagacttcggagcggtcgcaacctcgtggaagacgccaacctatccccaaggcgcgtcgacccgagggaaggtcctgggcacaaccaggatatccatggcctctttacggtaatgagggttgtgggtgggcaggatggctcttgtccccccgtggctctcgaccgtcttggggcccaaatgatccccggcggaggtcccgcaatttgggtaaggtcatcgataccctaacctgcggcttcgccgacctcatgggatacatcccgctcgtaggcgcccccgtgggtggcgtcgccagggccctggcacatggtgtcagggctttggaggacgggatcaattatgcaacagggaatctccccggttgctccttttctatcttcctcttggcacttctttcgtgcctgactgtccccgcttcggccgttaactatcgcaatgtctcgggcatctaccatgtcaccaatgactgcccgaattcaagcatagtgtatgaggccgaccatcacatcttgcaccttccaggttgcgtgccctgcgtgagagaggggaatcagtcacgctgctgggtggcccttactcctaccgtcgcagcgccatacatcggcgcaccgcttgagtccttacggagtcatgtggatttgatggtgggggccgccactgtttgctcgggtctttacatcggggacctgtgtggcggcttgttcctagttggccagatgttttcattccgaccacggcgccactggaccacccaggattgcaattgttccatctacacagggcacattacaggccacagaatggcctgggacatgatgatgaactggagtccaacaaccaccttagttctcgcccaggtcatgaggatcccaaccactctggtagacttactctctggaggccactggggtgtcctcgtgggagtggcctatttcagcatgcaggccaattgggccaaagtcatcttggtcctattcctctttgcaggggttgatgccgagactcacgtgtctggggcagcagtcggccggagtaccgccggcttggctaacctcttttcttctgggtctaagcagaatttacagctcatcaacagcaatgggagctggcatataaataggactgcccttaactgcaatgacagcttaaacactgggttcttggctagcttgttctacacccacaagtttaacagctcagggtgttccgaacggctcgcgtgctgcaagagccttgacagctacggccaaggctggggcccactcggggtcgctaacatcagcggctcgtctgatgacaggccttattgctggcactacgcgcctcggccgtgcgggattgtgccagcatccagtgtgtgtggccccgtgtattgtttcactcccagccctgtcgtggtcggtactactgatcacgtcggggtccctacttacacctggggggagaatgagactgatgtcttccttttgaactcgaccagaccgccgcatggtgcgtggtttggatgcgtgtggatgaacagtaccgggttcaccaaaacctgtggcgcccctccatgcgaggttaacaccaataatgggacctggcactgccccaccgattgcttcaggaagcatccggagactacctacgccaagtgcggatcagggccttggatcacaccgcgctgcctgattgattacccgtaccggctgtggcatttcccgtgcaccgccaacttctccgtctttaacatcaggacatttgtcggcggtatagagcatcggatgcaagcggcatgcaactggaccaggggggaagtctgtggcttggagcacagggatcgcgtagagctatcacccctgctccttaccactacagcgtggcagatcctcccctgctctttcaccactttacctgccctctccaccggcttgatccacctccaccaaaatatcgtggacgtccagtacctctatggtgttgggtctgcagtggtatcttgggcccttaagtgggaatatgtggtgctcgcgttcctgcttctcgcggacgcgagagtctctgcctgcctatggatgatgtttatggtaagtcaagttgaggcggctctgtccaacctgattaacatcaatgctgcttcagccgctggtgcccaaggcttctggtacgccatcctcttcatctgcattgtctggcatgtcaagggccggttcccagctgctgctgcctacgcagcctgcgggctgtggcccctgtttctcctgcttctgatgctgcctgagagggcttatgcatacgaccaggaagtggcagggtcccttggcggcgccatcgttgtcatgctgaccattctgacactgtctccgcactacaagttatggctggctaggggattgtggtggatccaatattttatagctaggaccgaggctgtgctgcatgtctatattccatccttcaacgtgcgcgggcctcgcgactcagtgattgttcttgcagtcctggtctgtccacacctagtatttgacatcacaaaatatcttctggccatcttagggcccctccacatactccaggcctcgctcctacgcatcccttactttgtgagggcacaagcgctggttaagatctgcagcttgttgcgtggggtagtttatggcaagtacttccaaatggtcgtgcttaaagcaggggccctgactggtacttacatctatgaccaccttactcccatgtcagattgggccgctacgggcctccgcgatttggcggtggccctagagccagttgtgttcacgcccatggagaagaaagtcatcgtctggggcgctgacaccgctgcgtgcggagacatcataaggggattacctgtttcggccaggttgggcaatgaaatcttgctcggaccagccgatacagaaacatcaaaggggtggagactccttgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 7 - DNA, 10266 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacgaatcctaaacctcaaagaaaaaccaaaagaaacaccaaccgccgcccacaggacgtcaagttcccgggcggtggtcagatcgttggtggagtttacttgttgccgcgcaggggccctaggttgggtgtgcgcgcaactcggaagacttcagaacggtcgcaaccccgtggacggcgtcagcctatccccaaggcgcgccagcccacgggccggtcctggggtcaacccgggtacccttggcccctttatgccaatgagggcctcgggtgggcagggtggttgctctccccccgaggctctcggcctaattggggccccaatgacccccggcggaaatcgcgcaacttgggtaaggtcatcgataccctgacgtgcggattcgccgacctcatggggtacatcccgctcgtaggcggccccgttgggggcgtcgcaagggctctcgcacacggtgtgagggtccttgaggacggggtaaactatgcaacagggaatttacccggttgctctttctctatctttatccttgcacttctttcatgcctgactgtcccgacctctgccgttccctaccgaaatgcctctggggtttatcatgtcaccaatgattgcccaaactcttctatcgtctatgaggctgaagacctgatcttacacgcacctggttgcgtgccctgtgttaggcagggtaatgtcagtaggtgctgggtccagatcacccccacactgtcagccccgagcctcggagcggtcacggctcctcttcggagggccgttgactacttagcggggggggctgccctttgctccgcgttatacgtcggagacgcgtgcggggcagtgtttttggtaggtcaaatgttcacctatagccctcgccggcataatgttgtgcaggactgcaactgttccatttacagtggccacatcaccggccaccggatggcatgggacatgatgatgaattggtcacctacaacagctttggtgatggcccagttgttacggattccccaggtggtcattgacatcattgccggggcccactggggggtcttgttcgccgccgcatactacgcgtcggcggctaactgggccaaggttgtgctggtcctgtttctgtttgcgggggtcgatgccagcacccgcactgtgggtggtagtgcggcccaaggcgcgcgcgggctcgcttcacttttcacccctgggccgcagcagaacttgcagctcataaataccaacgggagctggcacatcaacagaactgcccttaactgtaatgacagcctccagactgggtttgtagccggcctcctgtattatcacaagttcaactccactgggtgtccgcagcggatggctagctgtaggcccctcgccgcattcgaccagggctggggaactatcagctatgccgccgtgtcgggccccagtgatgacaagccctattgctggcactaccccccacgcccgtgcggaatagtgccagcgcgaggtgtctgcggtccggtctattgttttacacctagcccggtggtcgtcggcaccacagaccgcaaggggaatcccacttacagttggggcgaaaatgagactgacatctttctcttgaacaacacgaggccccctactggcaactggtttggctgcacctggatgaattccacagggtttgtcaagacttgcggggctccaccctgcaacttagggcctacaggcaacaatagccttaagtgtcctactgattgcttccgcaagcacccagacgccacctacaccaagtgtgggtcaggaccctggctcactccccggtgtctggtgcattacccttaccggttgtggcattacccgtgcaccctaaattacaccatcttcaaggtgcgcatgtacattgggggcctcgagcacaggctcgaggtggcatgcaactggacccgtggtgagcggtgtgatcttgaagacagggatagggccgagctgagcccgctcctacataccaccacgcagtgggccatattgccgtgctctttcacacccacacccgctcttagcactggtctcatacacttacatcaaaatatagtagacacccagtatctttacggtctgagctccagcatcgtctcgtgggccgttaagtgggagtacatagtgctggccttcttattacttgctgatgcccgtatttgtacttgcctatggatcatgctcctggtttgtcaggccgaagcggccctggagaacgtcattgtcctaaacgcggctgcggctgcggggactcatgggtttttctggggcctgctcgtcatctgcttcgcctggcacttcaagggcaggttggtccctggggccacctacctttgcttgggcatttggccattactcttactccttttcctcctgccccaaagggctctagccctggactcaagcgatggcgggactgtgggttgtcttgtgttaaccatccttacaatcttcacactcacccccgggtacaagaagatggtagtgttggtcatatggtggcttcagtatttcatagcccgggtagaggcctttatccatgtgtgggtgcccccgttgcaggttaggggtggtcgtgatgctattatcatgctcacatgccttttccatcctgccctggggtttgaggtcacgaaaatcctcctcgggatactaggtcctttgtacctgctgcagtactcgctcatcaagctgccttatttcatcagggcgcgcgccctgctgagggcgtgcctgctagcgaagcacttggcctgtggcaggtacgtgcaggcggccttgctccaccttggtaggctgaccggaacgtacatttatgaccaccttgcccccatgaaggattgggcagcgtccgggctgcgcgacttagcagtggccacggagcccatcatattctcccctatggagacgaaggtcatcacgtggggggctgacacggccgcatgtggggacatacttgccggccttcctgtatcagctaggcgaggccatgaaatcttcctggggccagccgatgacatcagagaggcgggctggcgacttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 8 - DNA, 10281 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacacttccaaaaccccaaagaaaaaccaaaagaaacaccaaccgtcgcccaatggacgtcaagttcccgggtggcggtcagatcgttggcggagtttacttgttgccgcgcaggggcccccggttgggtgtgcgcgcgacgaggaagacttccgagcgatcccagcccagaggcaggcgccaacctataccaaaggcgcgccagccccagggcaggcactgggctcagcccggatatccttggcccctttatgggaacgagggctgtgggtgggcaggttggctcctgtccccccgcggctcccggccacactggggccccaacgacccccggcgtcgatcccggaatttgggtaaggtcatcgataccctaacgtgtgggttcgccgatctcatggggtacattcccgtcgtgggcgcgcctttgggcggcgtcgcggctgcactcgcacatggtgtgagggcaatcgaggacgggatcaattatgcaacagggaatcttcccggttgctctttctctatcttcctcttggcactactctcgtgcctcacaacgccagcgtcggctcttacctacggtaactccagtgggctataccatcttacaaatgattgccccaactccagcatcgtgctggaggcggatgccatgatcttgcatttgcctggatgcttgccttgtgtgagggtcaataacaaccagtccatctgttggcatgctgtgtcccccaccctagccataccaaatgcttccacacctgcaacgggattccgtaggcatgtggaccttcttgcgggcgccgcagtggtttgctcatccctgtacatcggggatctgtgcggctccctctttttggcagggcaactatttacctttcagccccgccgtcactggactgtgcaagactgcaactgctccatttatacaggccacgtcaccggccacaggatggcttgggacatgatgatgaattggtcacccacaaccactctggtcctatctagtatcttgagggtacctgagatctgtgcgagtgtgatatttggtggccattgggggatactactagccgttgcctactttggtatggctggcaactggctaaaagttctggctgtcctgttcttatttgcaggggttgaagcaaccaccaccatcggccatcaagtaggccgcactactggtggcttagccagtctcttctccatcggtcccaggcaaaatctacaactcatcaacaccaatggcagctggcatataaacaggactgctctgaactgcaatgattccctccagacggggttcataacgtcactcttttatgccaagaacgtcaactcctcgggctgcccagagcggatggctgcgtgtaagcccctcgcggacttccggcaggggtggggccaaataacctacaaagtcaacatctcgggcccctccgacgaccgtccctactgttggcattacgctcccaggccatgtgacgtggtgtcggcccgcacggtgtgcggccccgtttactgcttcacgcccagccctgtcgtagtaggaaccactgacaagctgggcattcccacatacaactggggggagaatgagacggatgtgttcatgttggaaagccttcggcctcctactggaggatggtttgggtgcacgtggatgaactctacgggctttaccaagacctgtggtgccccgccatgtcagatagtcccgggagattacaatagctctgccaatgagcttttgtgccccaccgactgcttccgtaaacatccggaagctacatatcagcggtgtggatcgggaccctggatcacacctaggtgtctggtggattacccctacaggctgtggcactacccctgtactgtcaacttcaccttgcataaagtcaggatgttcgtgggaggcattgagcatcggtttgacgccgcatgtaactggaccagaggcgagcggtgtgatctacatgacagagacaggattgaaatgagcccgctgcttttctcaactacgcagcttgccatacttccctgttcattttccaccatgccggccttgtcaaccggcctcatccacctgcatcagaacatagtggacgtgcagtacctctacggagtctcctcgagcgttacctcgtgggtggtgaagtgggagtacattgttctggtgttcctggttctggcagatgctcggatttgtacatgtctctggttaatgctgctcataaccaacgttgaagcagcagtggaaaggcttgtcgtcctcaatgcggctagcgccgccggcaccgccggctggtggtgggcggtgctcttcctgtgctgtgcttggtacgtgaaaggccgccttgtgcctgcgtgtacctacatggcactgggaatgtggccgttgctcctgacaatcttggccctgcctcgccgagcatacgctatggacaatgagcaagcggcatccctcggagctgttggtctcttggtgctcaccatctttaccatcacccccatgtacaagaagctgttgacctgctccatttggtggaatcagtatttcctcgcccgagctgaggccatgatacacgagtgggtgcccgacctacgggttaggggcggtagggactccatcatcttacttacctgcttgttacatccacagctggggtttgaggtcaccaaaattctactagccatcctggcccctctatacatcctgcagtacagtttgctcaaggtgccttactttgtgcgcgcccacgtactcctgcgtgcttgcctgcttgttcgtaggctagcagggggtaagtacgtgcaggcgtgccttctgaggttgggcgcttggactggcacctttgtctatgaccatctcgcccctctctctgactgggctagcgacggactgcgcgatttggcagtcgcaatcgagccggtcattttctctcccatggagaagaaaatcattacctggggtgcggataccgccgcgtgtggtgacatcttgagtggcctcccggtgtcagcgaggttggggaatttggtgctactgggacccgcggacgatatgcagcgcgggggttggaagcttttggctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 9 - DNA, 10275 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacgaatcctaaacctcaaagattaaccaaaagaaacaccgtccgtcgcccacagaacgttaagttcccgggtggcgggcagatcgttggcggagtctacttgttgccgcgcaggggccctagattgggtgtgcgcggcactaggaagagttcggagcgatcgcagcccaggggaagacgccaacgtatccccaaagctgcctcttcacagggtaaagcctggggcaagcccgggtacccttggcccctgtatggtaacgagggctgtggctgggcagggtggctcctgtccccccgcggctctcgacctacttggggccccactgacccccggcaccgctcgcgaaacctcggtaaggtgatcgacaccatgacctgcgggtttgccgacctcatggggtacatccctgtcctaggcgcccccctagggggcgttgccagggctctggcacatggtgttagagttctggaggacggggtcaactatgcaacagggaacttgcctggttgctccttttctatcttcttactagccctcctgtcatgtctaacagtcccggcatcggcttatgaagtccgcaactccagtggggtctatcatctcaccaatgactgccccaacgctagtatagtctatgaaacagacaacgccatcctacacgagcctgggtgcgtgccttgcgttcgcgagggtaatactagcaggtgttgggaaccagtggcccccactttggcggtccgctatcgcggagcgcttactgacgatttgcggacgcatattgacctagtggtggcgtcagctaccctgtgctccgccttgtacgtgggggacatttgtggagccatcttcattgccagccaagctgttctctggaagcccggggggggtcggatagtgcaagattgcaattgttcgatctacccgggccacgtcaccggccacaggatggcgtgggacatgatgcagaactgggcgccggccttgtcaatggttgccgcttacgctgtgagagtgcccggtgtcatcattaccactgtagcgggcggccactggggtgtgttatttggcctcgcttactttggtatggcgggaaactgggcaaaggtaatactcatcatgctactcatgtccggcgtcgacgcggaaaccatggccgtcggggctagggccgctcacaccactggcgcccttgtcagcctgctcaatccagggcccagtcagcgcctgcagctgatcaacaccaatgggtcatggcacatcaaccggaccgctttgaactgcaatgactctttgcagacagggttcatagcggccctcttctacacacataggttcaattctagtggctgtcccgagaggatggcttcttgtaaacctctcagtgactttgaccaggggtggggcccgctgtggtacaattcaacagaaagaccttcggaccagcgaccctattgctggcactacgcgccatcgccgtgtggtattgtgccggctaaggatgtttgcggtccggtctactgctttacaccaagcccggttgtggtgggcaccacggatcgccggggggtgcccacgtatacttggggtgaaaatgagtctgatgtcttcctgctcaacagcacaaggccgccgcaaggcagttggtttgggtgctcatggatgaacacaacggggttcacgaagacctgcggaggtcctccgtgcaagatacgtccccagggtgcccagagtaacacctctctcacttgtcccacagactgcttcaggaaacatccgcgtgccacatactccgcttgcggatctggtccgtggttgacacctagatgcatggtccattacccctatagactgtggcactacccgtgtacagtcaacttcaccatacacaaagtcaggttatacatagggggtgtagaacataggctcgatgcagcgtgcaattggacgcggggtgagcgatgcgacctggaggaccgagacagggtggacatgtcccccctgctccattccactacggagctcgcaatacttccgtgttcctttgtgccgcttccggccttatctacgggactgatccacctgcaccaaaacatcgttgacgcccagtacctttatggtctttctcccgctataataagctgggccatcagatgggagtgggtagtcctcgttttcctactcctggcggacgcgcggatctgcgcctgcctttggatgatgatgcttatggcccaggctgaagccgctctggagaacttgatccacctcaacgcggccagccttgcgggaacccatggtatctggtggctccttttagtcttttgtgcctcttggcatctacgaggcagggttgtccctctggtgacgtatgggatatgcgggatgtggcccttcttcctcatgttgctgagcctccccccacgagcgtatgctctggacagggaagtgagcgcagcgttgggaacgggcatgctcgccatcatcctattagttaccttgggaccgcactacaagagacttctagcccttattctctggtgggtcacatatttccttacaaggtgtgaagcagcactccaaacgtgggtccctcctctcaaccctcgggggggcagggacggtttcatcctgtgtgtgctgctgtgctatccaggccttgtctttgacatcacaaaatggttgctggtcatgatgtgccctctctacctcctccagttgtgtttggtgaggactccatactttgtgagggcccaggccctcatcagagtgtgttctctcttcaaaacgctagctgggggacggtacgtgcaggccgcgctgctcactattggccgctggaccggcacttatatttataaccatctcgcccccctggaaacatgggccgccggcggcctacgggatttggccgttgcagtcgagcccgtgatattctcccccatggagaagaagatcatagtttggggggcggagaccactgcttgtggcgacattctttgtggcctgcctgtctcagctcggctcggcagggaagtcctgctagggcccgcggatgactacaggtccatgggatggcaactcctggctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 10 - DNA, 10491 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccatggcttccaaggtgtacgaccccgagcaacgcaaacgcatgatcactgggcctcagtggtgggctcgctgcaagcaaatgaacgtgctggactccttcatcaactactatgattccgagaagcacgccgagaacgccgtgatttttctgcatggtaacgctgcctccagctacctgtggaggcacgtcgtgcctcacatcgagcccgtggctagatgcatcatccctgatctgatcggaatgggtaagtccggcaagagcgggaatggctcatatcgcctcctggatcactacaagtacctcaccgcttggttcgagctgctgaaccttccaaagaaaatcatctttgtgggccacgactggggggcttgtctggcctttcactactcctacgagcaccaagacaagatcaaggccatcgtccatgctgagagtgtcgtggacgtgatcgagtcctgggacgagtggcctgacatcgaggaggatatcgccctgatcaagagcgaagagggcgagaaaatggtgcttgagaataacttcttcgtcgagaccatgctcccaagcaagatcatgcggaaactggagcctgaggagttcgctgcctacctggagccattcaaggagaagggcgaggttagacggcctaccctctcctggcctcgcgagatccctctcgttaagggaggcaagcccgacgtcgtccagattgtccgcaactacaacgcctaccttcgggccagcgacgatctgcctaagatgttcatcgagtccgaccctgggttcttttccaacgctattgtcgagggagctaagaagttccctaacaccgagttcgtgaaggtgaagggcctccacttcagccaggaggacgctccagatgaaatgggtaagtacatcaagagcttcgtggagcgcgtgctgaagaacgagcagctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 11 - protein, 3228 aa, Hepatitis C virus
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSSGLYHVTNDCPNSSIVYEAADAILHTPGCVPCVREGNASRCWVAVTPTVATRDGKLPTTQLRRHIDLLVGSATLCSALYVGDLCGSVFLVGQLFTFSPRRHWTTQDCNCSIYPGHITGHRMAWDMMMNWSPTAALVVAQLLRIPQAIMDMIAGAHWGVLAGIAYFSMVGNWAKVLVVLLLFAGVDAETHVTGGNAGRTTAGLVGLLTPGAKQNIQLINTNGSWHINSTALNCNESLNTGWLAGLFYQHKFNSSGCPERLASCRRLTDFAQGWGPISYANGSGLDERPYCWHYPPRPCGIVPAKSVCGPVYCFTPSPVVVGTTDRSGAPTYSWGANDTDVFVLNNTRPPLGNWFGCTWMNSTGFTKVCGAPPCVIGGVGNNTLLCPTDCFRKHPEATYSRCGSGPWITPRCMVDYPYRLWHYPCTINYTIFKVRMYVGGVEHRLEAACNWTRGERCDLEDRDRSELSPLLLSTTQWQVLPCSFTTLPALSTGLIHLHQNIVDVQYLYGVGSSIASWAIKWEYVVLLFLLLADARVCSCLWMMLLISQAEAALENLVILNAASLAGTHGLVSFLVFFCFAWYLKGRWVPGAVYALYGMWPLLLLLLALPQRAYALDTEVAASCGGVVLVGLMALTLSPYYKRYISWCMWWLQYFLTRVEAQLHVWVPPLNVRGGRDAVILLMCVVHPTLVFDITKLLLAIFGPLWILQASLLKVPYFVRVQGLLRICALARKIAGGHYVQMAIIKLGALTGTYVYNHLTPLRDWAHNGLRDLAVAVEPVVFSRMETKLITWGADTAACGDIINGLPVSARRGQEILLGPADGMVSKGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYKLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 12 - protein, 3228 aa, Hepatitis C virus
MSTNPKPQRKTKRNTNRRPQDVKFPGGGQIVGGVYLLPRRGPRLGVRATRKASERSQPRGRRQPIPKARRPEGRAWAQPGYPWPLYGNEGLGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTIPASAYEVRNVSGIYHVTNDCSNSSIVYEAADVIMHTPGCVPCVQEGNSSRCWVALTPTLAARNASVPTTTIRRHVDLLVGTAAFCSAMYVGDLCGSIFLVSQLFTFSPRRHETVQDCNCSIYPGHVSGHRMAWDMMMNWSPTTALVVSQLLRIPQAVVDMVAGAHWGVLAGLAYYSMVGNWAKVLIVALLFAGVDGETHTTGRVAGHTTSGFTSLFSSGASQKIQLVNTNGSWHINRTALNCNDSLQTGFFAALFYAHKFNSSGCPERMASCRPIDWFAQGWGPITYTKPNSSDQRPYCWHYAPRPCGVVPASQVCGPVYCFTPSPVVVGTTDRSGVPTYSWGENETDVMLLNNTRPPQGNWFGCTWMNSTGFTKTCGGPPCNIGGVGNRTLICPTDCFRKHPEATYTKCGSGPWLTPRCLVDYPYRLWHYPCTLNFSIFKVRMYVGGVEHRLNAACNWTRGERCNLEDRDRSELSPLLLSTTEWQILPCAFTTLPALSTGLIHLHQNIVDVQYLYGVGSAFVSFAIKWEYILLLFLLLADARVCACLWMMLLIAQAEAALENLVVLNAASVAGAHGILSFLVFFCAAWYIKGRLAPGAAYAFYGVWPLLLLLLALPPRAYALDREMAASCGGAVLVGLVFLTLSPYYKVFLTRLIWWLQYFITRAEAHMQVWVPPLNVRGGRDAIILLTCAVHPELIFDITKLLLAILGPLMVLQAGITRVPYFVRAQGLIRACMLVRKVAGGHYVQMVFMKLGALTGTYVYNHLTPLRDWAHAGLRDLAVAVEPVVFSAMETKVITWGADTAACGDIILGLPVSARRGKEIFLGPADSLEGQGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYKLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 13 - protein, 3232 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYKLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 14 - protein, 3232 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGCGWAGWLLSPRGSRPTWGPTDPRHRSRNLGRVIDTITCGFADLMGYIPVVGAPVGGVARALAHGVRVLEDGINYATGNLPGCSFSIFLLALLSCVTVPVSAVEVRNISSSYYATNDCSNNSITWQLTDAVLHLPGCVPCENDNGTLHCWIQVTPNVAVKHRGALTRSLRTHVDMIVMAATACSALYVGDVCGAVMILSQAFMVSPQRHNFTQECNCSIYQGHITGHRMAWDMMLNWSPTLAMILAYAARVPEMVLEIIFGGHWGVVFGLAYFSMQGAWAKVIAILLLVAGVDATTYSSGQEAGRTVLGFTNLFTSGAKQNLYLINTNGSWHINRTALNCNDSLQTGFMASLFYTHRFNSSGCPERLSSCRGLDDFRIGWGTLEYETHVTNDEDMRPYCWHYPPRPCGIVPARTVCGPVYCFTPSPVVVGTTDKQGVPTYTWGENETDVFLLNSTRPPRGAWFGCTWMNGTGFTKTCGAPPCRIRKDYNSTIDLLCPTDCFRKHPDATYLKCGAGPWLTPRCLVDYPYRLWHYPCTVNFTIFKARMYVGGVEHRFSAACNFTRGDRCRLEDRDRGQQSPLLHSTTEWAVLPCSFSDLPALSTGLLHLHQNIVDVQYLYGLSPALTRYIVKWEWVILLFLLLADARICACLWMLIILGQAEAALEKLIILHSASAASANGPLWFFIFFTAAWYLKGRVVPVATYSVLGLWSFLLLVLALPQQAYALDAAEQGELGLAILVIISIFTLTPAYKILLSRSVWWLSYMLVLAEAQIQQWVPPLEVRGGRDGIIWVAVILHPRLVFEVTKWLLAILGPAYLLKASLLRIPYFVRAHALLRVCTLVKHLAGARYIQMLLITIGRWTGTYIYDHLSPLSTWAAQGLRDLAIAVEPVVFSPMEKKVIVWGAETVACGDILHGLPVSARLGREVLLGPADGYTSKGWKLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYKLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 15 - protein, 3234 aa, Hepatitis C virus
MSTLPKPQRKTKRNTIRRPQDVKFPGGGQIVGGVYVLPRRGPRLGVRATRKTSERSQPRGRRQPIPKARRSEGRSWAQPGYPWPLYGNEGCGWAGWLLSPRGSRPSWGPNDPRRRSRNLGKVIDTLTCGFADLMGYIPLVGAPVGGVARALAHGVRALEDGINFATGNLPGCSFSIFLLALFSCLVHPAASLEWRNTSGLYVLTNDCSNSSIVYEADDVILHTPGCVPCVQDDNTSTCWTPVTPTVAVRYVGATTASIRSHVDLLVGAATLCSALYVGDMCGAVFLVGQAFTFRPRRHQTVQTCNCSLYPGHVSGHRMAWDMMMNWSPAVGMVVAHILRLPQTLFDILAGAHWGILAGLAYYSMQGNWAKVAIVMIMFSGVDAETYVTGGSVAHSARGLTSLFSMGAKQKLQLVNTNGSWHINSTALNCNESINTGFIAGLFYYHKFNSTGCPQRLSSCKPIISFRQGWGPLTDANITGPSDDRPYCWHYAPRPCSVVPASSVCGPVYCFTPSPVVVGTTDIKGKPTYNWGENETDVFLLESLRPPSGRWFGCAWMNSTGFLKTCGAPPCNIYGGEGDPENETDLFCPTDCFRKHPEATYSRCGAGPWLTPRCMVDYPYRLWHYPCTVNFTLFKVRMFVGGFEHRFTAACNWTRGERCNIEDRDRSEQHPLLHSTTELAILPCSFTPMPALSTGLIHLHQNIVDVQYLYGVGSDMVGWALKWEFVILVFLLLADARVCVALWLMLMVSQAEAALENLVTLNAVAAAGTHGIGWYLVAFCAAWYVRGKLVPLTIYGLTGLWSLALLVLLLPQRAYAWSGEDSATLGAGVLALFGFFTLSPWYKHWIGRLMWWNQYTICRCEAALQVWVPPLLARGSRDGVILLTSLLYPSLIFDITKLLIAVIGPLYLIQAAITTTPYFVRAHVLVRLCMLVRSVMGGKYFQMAILSIGRWFNTYLYDHLAPMQHWAAAGLKDLAVATEPVIFSPMEIKVITWGADTAACGDILCGLPVSARLGREVLLGPADDYREMGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYKLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 16 - protein, 3228 aa, Hepatitis C virus
MSTNPKPQRKTKRNTNRRPMDVKFPGGGQIVGGVYLLPRRGPRLGVRATRKTSERSQPRGRRQPIPKARRPEGRSWAQPGYPWPLYGNEGCGWAGWLLSPRGSRPSWGPNDPRRRSRNLGKVIDTLTCGFADLMGYIPLVGAPVGGVARALAHGVRALEDGINYATGNLPGCSFSIFLLALLSCLTVPASAVNYRNVSGIYHVTNDCPNSSIVYEADHHILHLPGCVPCVREGNQSRCWVALTPTVAAPYIGAPLESLRSHVDLMVGAATVCSGLYIGDLCGGLFLVGQMFSFRPRRHWTTQDCNCSIYTGHITGHRMAWDMMMNWSPTTTLVLAQVMRIPTTLVDLLSGGHWGVLVGVAYFSMQANWAKVILVLFLFAGVDAETHVSGAAVGRSTAGLANLFSSGSKQNLQLINSNGSWHINRTALNCNDSLNTGFLASLFYTHKFNSSGCSERLACCKSLDSYGQGWGPLGVANISGSSDDRPYCWHYAPRPCGIVPASSVCGPVYCFTPSPVVVGTTDHVGVPTYTWGENETDVFLLNSTRPPHGAWFGCVWMNSTGFTKTCGAPPCEVNTNNGTWHCPTDCFRKHPETTYAKCGSGPWITPRCLIDYPYRLWHFPCTANFSVFNIRTFVGGIEHRMQAACNWTRGEVCGLEHRDRVELSPLLLTTTAWQILPCSFTTLPALSTGLIHLHQNIVDVQYLYGVGSAVVSWALKWEYVVLAFLLLADARVSACLWMMFMVSQVEAALSNLININAASAAGAQGFWYAILFICIVWHVKGRFPAAAAYAACGLWPLFLLLLMLPERAYAYDQEVAGSLGGAIVVMLTILTLSPHYKLWLARGLWWIQYFIARTEAVLHVYIPSFNVRGPRDSVIVLAVLVCPHLVFDITKYLLAILGPLHILQASLLRIPYFVRAQALVKICSLLRGVVYGKYFQMVVLKAGALTGTYIYDHLTPMSDWAATGLRDLAVALEPVVFTPMEKKVIVWGADTAACGDIIRGLPVSARLGNEILLGPADTETSKGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYKLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 17 - protein, 3229 aa, Hepatitis C virus
MSTNPKPQRKTKRNTNRRPQDVKFPGGGQIVGGVYLLPRRGPRLGVRATRKTSERSQPRGRRQPIPKARQPTGRSWGQPGYPWPLYANEGLGWAGWLLSPRGSRPNWGPNDPRRKSRNLGKVIDTLTCGFADLMGYIPLVGGPVGGVARALAHGVRVLEDGVNYATGNLPGCSFSIFILALLSCLTVPTSAVPYRNASGVYHVTNDCPNSSIVYEAEDLILHAPGCVPCVRQGNVSRCWVQITPTLSAPSLGAVTAPLRRAVDYLAGGAALCSALYVGDACGAVFLVGQMFTYSPRRHNVVQDCNCSIYSGHITGHRMAWDMMMNWSPTTALVMAQLLRIPQVVIDIIAGAHWGVLFAAAYYASAANWAKVVLVLFLFAGVDASTRTVGGSAAQGARGLASLFTPGPQQNLQLINTNGSWHINRTALNCNDSLQTGFVAGLLYYHKFNSTGCPQRMASCRPLAAFDQGWGTISYAAVSGPSDDKPYCWHYPPRPCGIVPARGVCGPVYCFTPSPVVVGTTDRKGNPTYSWGENETDIFLLNNTRPPTGNWFGCTWMNSTGFVKTCGAPPCNLGPTGNNSLKCPTDCFRKHPDATYTKCGSGPWLTPRCLVHYPYRLWHYPCTLNYTIFKVRMYIGGLEHRLEVACNWTRGERCDLEDRDRAELSPLLHTTTQWAILPCSFTPTPALSTGLIHLHQNIVDTQYLYGLSSSIVSWAVKWEYIVLAFLLLADARICTCLWIMLLVCQAEAALENVIVLNAAAAAGTHGFFWGLLVICFAWHFKGRLVPGATYLCLGIWPLLLLLFLLPQRALALDSSDGGTVGCLVLTILTIFTLTPGYKKMVVLVIWWLQYFIARVEAFIHVWVPPLQVRGGRDAIIMLTCLFHPALGFEVTKILLGILGPLYLLQYSLIKLPYFIRARALLRACLLAKHLACGRYVQAALLHLGRLTGTYIYDHLAPMKDWAASGLRDLAVATEPIIFSPMETKVITWGADTAACGDILAGLPVSARRGHEIFLGPADDIREAGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYKLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 18 - protein, 3234 aa, Hepatitis C virus
MSTLPKPQRKTKRNTNRRPMDVKFPGGGQIVGGVYLLPRRGPRLGVRATRKTSERSQPRGRRQPIPKARQPQGRHWAQPGYPWPLYGNEGCGWAGWLLSPRGSRPHWGPNDPRRRSRNLGKVIDTLTCGFADLMGYIPVVGAPLGGVAAALAHGVRAIEDGINYATGNLPGCSFSIFLLALLSCLTTPASALTYGNSSGLYHLTNDCPNSSIVLEADAMILHLPGCLPCVRVNNNQSICWHAVSPTLAIPNASTPATGFRRHVDLLAGAAVVCSSLYIGDLCGSLFLAGQLFTFQPRRHWTVQDCNCSIYTGHVTGHRMAWDMMMNWSPTTTLVLSSILRVPEICASVIFGGHWGILLAVAYFGMAGNWLKVLAVLFLFAGVEATTTIGHQVGRTTGGLASLFSIGPRQNLQLINTNGSWHINRTALNCNDSLQTGFITSLFYAKNVNSSGCPERMAACKPLADFRQGWGQITYKVNISGPSDDRPYCWHYAPRPCDVVSARTVCGPVYCFTPSPVVVGTTDKLGIPTYNWGENETDVFMLESLRPPTGGWFGCTWMNSTGFTKTCGAPPCQIVPGDYNSSANELLCPTDCFRKHPEATYQRCGSGPWITPRCLVDYPYRLWHYPCTVNFTLHKVRMFVGGIEHRFDAACNWTRGERCDLHDRDRIEMSPLLFSTTQLAILPCSFSTMPALSTGLIHLHQNIVDVQYLYGVSSSVTSWVVKWEYIVLVFLVLADARICTCLWLMLLITNVEAAVERLVVLNAASAAGTAGWWWAVLFLCCAWYVKGRLVPACTYMALGMWPLLLTILALPRRAYAMDNEQAASLGAVGLLVLTIFTITPMYKKLLTCSIWWNQYFLARAEAMIHEWVPDLRVRGGRDSIILLTCLLHPQLGFEVTKILLAILAPLYILQYSLLKVPYFVRAHVLLRACLLVRRLAGGKYVQACLLRLGAWTGTFVYDHLAPLSDWASDGLRDLAVAIEPVIFSPMEKKIITWGADTAACGDILSGLPVSARLGNLVLLGPADDMQRGGWKLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYKLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 19 - protein, 3232 aa, Hepatitis C virus
MSTNPKPQRLTKRNTVRRPQNVKFPGGGQIVGGVYLLPRRGPRLGVRGTRKSSERSQPRGRRQRIPKAASSQGKAWGKPGYPWPLYGNEGCGWAGWLLSPRGSRPTWGPTDPRHRSRNLGKVIDTMTCGFADLMGYIPVLGAPLGGVARALAHGVRVLEDGVNYATGNLPGCSFSIFLLALLSCLTVPASAYEVRNSSGVYHLTNDCPNASIVYETDNAILHEPGCVPCVREGNTSRCWEPVAPTLAVRYRGALTDDLRTHIDLVVASATLCSALYVGDICGAIFIASQAVLWKPGGGRIVQDCNCSIYPGHVTGHRMAWDMMQNWAPALSMVAAYAVRVPGVIITTVAGGHWGVLFGLAYFGMAGNWAKVILIMLLMSGVDAETMAVGARAAHTTGALVSLLNPGPSQRLQLINTNGSWHINRTALNCNDSLQTGFIAALFYTHRFNSSGCPERMASCKPLSDFDQGWGPLWYNSTERPSDQRPYCWHYAPSPCGIVPAKDVCGPVYCFTPSPVVVGTTDRRGVPTYTWGENESDVFLLNSTRPPQGSWFGCSWMNTTGFTKTCGGPPCKIRPQGAQSNTSLTCPTDCFRKHPRATYSACGSGPWLTPRCMVHYPYRLWHYPCTVNFTIHKVRLYIGGVEHRLDAACNWTRGERCDLEDRDRVDMSPLLHSTTELAILPCSFVPLPALSTGLIHLHQNIVDAQYLYGLSPAIISWAIRWEWVVLVFLLLADARICACLWMMMLMAQAEAALENLIHLNAASLAGTHGIWWLLLVFCASWHLRGRVVPLVTYGICGMWPFFLMLLSLPPRAYALDREVSAALGTGMLAIILLVTLGPHYKRLLALILWWVTYFLTRCEAALQTWVPPLNPRGGRDGFILCVLLCYPGLVFDITKWLLVMMCPLYLLQLCLVRTPYFVRAQALIRVCSLFKTLAGGRYVQAALLTIGRWTGTYIYNHLAPLETWAAGGLRDLAVAVEPVIFSPMEKKIIVWGAETTACGDILCGLPVSARLGREVLLGPADDYRSMGWQLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYKLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 20 - protein, 3304 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPMASKVYDPEQRKRMITGPQWWARCKQMNVLDSFINYYDSEKHAENAVIFLHGNAASSYLWRHVVPHIEPVARCIIPDLIGMGKSGKSGNGSYRLLDHYKYLTAWFELLNLPKKIIFVGHDWGACLAFHYSYEHQDKIKAIVHAESVVDVIESWDEWPDIEEDIALIKSEEGEKMVLENNFFVETMLPSKIMRKLEPEEFAAYLEPFKEKGEVRRPTLSWPREIPLVKGGKPDVVQIVRNYNAYLRASDDLPKMFIESDPGFFSNAIVEGAKKFPNTEFVKVKGLHFSQEDAPDEMGKYIKSFVERVLKNEQLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 21 - DNA, 9667 bp, Hepatitis C virus
gccagccccctgatgggggcgacactccaccatgaatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggataaacccgctcaatgcctggagatttgggcgtgcccccgcaagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgtcgcccacaggacgtcaagttcccgggtggcggtcagatcgttggtggagtttacttgttgccgcgcaggggccctagattgggtgtgcgcgcgacgaggaagacttccgagcggtcgcaacctcgaggtagacgtcagcctatccccaaggcacgtcggcccgagggcaggacctgggctcagcccgggtacccttggcccctctatggcaatgagggttgcgggtgggcgggatggctcctgtctccccgtggctctcggcctagctggggccccacagacccccggcgtaggtcgcgcaatttgggtaaggtcatcgatacccttacgtgcggcttcgccgacctcatggggtacataccgctcgtcggcgcccctcttggaggcgctgccagggccctggcgcatggcgtccgggttctggaagacggcgtgaactatgcaacagggaaccttcctggttgctctttctctatcttccttctggccctgctctcttgcctgactgtgcccgcttcagcctaccaagtgcgcaattcctcggggctttaccatgtcaccaatgattgccctaactcgagtattgtgtacgaggcggccgatgccatcctgcacactccggggtgtgtcccttgcgttcgcgagggtaacgcctcgaggtgttgggtggcggtgacccccacggtggccaccagggacggcaaactccccacaacgcagcttcgacgtcatatcgatctgcttgtcgggagcgccaccctctgctcggccctctacgtgggggacctgtgcgggtctgtctttcttgttggtcaactgtttaccttctctcccaggcgccactggacgacgcaagactgcaattgttctatctatcccggccatataacgggtcatcgcatggcatgggatatgatgatgaactggtcccctacggcagcgttggtggtagctcagctgctccggatcccacaagccatcatggacatgatcgctggtgctcactggggagtcctggcgggcatagcgtatttctccatggtggggaactgggcgaaggtcctggtagtgctgctgctatttgccggcgtcgacgcggaaacccacgtcaccgggggaaatgccggccgcaccacggctgggcttgttggtctccttacaccaggcgccaagcagaacatccaactgatcaacaccaacggcagttggcacatcaatagcacggccttgaattgcaatgaaagccttaacaccggctggttagcagggctcttctatcaacacaaattcaactcttcaggctgtcctgagaggttggccagctgccgacgccttaccgattttgcccagggctggggtcctatcagttatgccaacggaagcggcctcgacgaacgcccctactgctggcactaccctccaagaccttgtggcattgtgcccgcaaagagcgtgtgtggcccggtatattgcttcactcccagccccgtggtggtgggaacgaccgacaggtcgggcgcgcctacctacagctggggtgcaaatgatacggatgtcttcgtccttaacaacaccaggccaccgctgggcaattggttcggttgtacctggatgaactcaactggattcaccaaagtgtgcggagcgcccccttgtgtcatcggaggggtgggcaacaacaccttgctctgccccactgattgcttccgcaaacatccggaagccacatactctcggtgcggctccggtccctggattacacccaggtgcatggtcgactacccgtataggctttggcactatccttgtaccatcaattacaccatattcaaagtcaggatgtacgtgggaggggtcgagcacaggctggaagcggcctgcaactggacgcggggcgaacgctgtgatctggaagacagggacaggtccgagctcagcccgttgctgctgtccaccacacagtggcaggtccttccgtgttctttcacgaccctgccagccttgtccaccggcctcatccacctccaccagaacattgtggacgtgcagtacttgtacggggtagggtcaagcatcgcgtcctgggccattaagtgggagtacgtcgttctcctgttccttctgcttgcagacgcgcgcgtctgctcctgcttgtggatgatgttactcatatcccaagcggaggcggctttggagaacctcgtaatactcaatgcagcatccctggccgggacgcacggtcttgtgtccttcctcgtgttcttctgctttgcgtggtatctgaagggtaggtgggtgcccggagcggcctacgccctctacgggatgtggcctctcctcctgctcctgctggcgttgcctcagcgggcatacgcactggacacggaggtggccgcgtcgtgtggcggcgttgttcttgtcgggttaatggcgctgactctgtcgccatattacaagcgctatatcagctggtgcatgtggtggcttcagtattttctgaccagagtagaagcgcaactgcacgtgtgggttccccccctcaacgtccggggggggcgcgatgccgtcatcttactcatgtgtgtagtacacccgaccctggtatttgacatcaccaaactactcctggccatcttcggacccctttggattcttcaagccagtttgcttaaagtcccctacttcgtgcgcgttcaaggccttctccggatctgcgcgctagcgcggaagatagccggaggtcattacgtgcaaatggccatcatcaagttaggggcgcttactggcacctatgtgtataaccatctcacccctcttcgagactgggcgcacaacggcctgcgagatctggccgtggctgtggaaccagtcgtcttctcccgaatggagaccaagctcatcacgtggggggcagataccgccgcgtgcggtgacatcatcaacggcttgcccgtctctgcccgtaggggccaggagatactgcttgggccagccgacggaatggtctccaaggggtggaggttgctggctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgccctggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacctatgacgtggacatggtcgatgccaacctgctcatggagggcggtgtggctcagacagagcctgagtccagggtgcccgttctggactttctcgagccaatggccgaggaagagagcgaccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 22 - DNA, 9667 bp, Hepatitis C virus
gccagcccccgattgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaaggcttccgagcggtcgcaacctcgtggaaggcgacaacctatcccaaaggctcgccgacccgagggcagggcctgggctcagcccgggtacccttggcccctctatggcaatgagggcctggggtgggcaggatggctcctgtcaccccgcggctcccggcctagttggggccccacggacccccggcgtaggtcgcgtaacttgggtaaggtcatcgatacccttacatgcggcttcgccgatctcatggggtacattccgctcgtcggcgcccccctagggggcgctgccagggccttggcacacggtgtccgggttctggaggacggcgtgaactatgcaacagggaacttgcccggttgctctttctctatcttcctcttggctctgctgtcctgtttgaccatcccagcttccgcttatgaagtgcgcaacgtgtccgggatataccatgtcacgaacgactgctccaactcaagcattgtgtatgaggcagcggacgtgatcatgcatactcccgggtgcgtgccctgtgttcaggagggtaacagctcccgttgctgggtagcgctcactcccacgctcgcggccaggaatgccagcgtccccactacgacaatacgacgccacgtcgacttgctcgttgggacggctgctttctgctccgctatgtacgtgggggatctctgcggatctattttcctcgtctcccagctgttcaccttctcgcctcgccggcatgagacagtgcaggactgcaactgctcaatctatcccggccatgtatcaggtcaccgcatggcttgggatatgatgatgaactggtcacctacaacagccctagtggtgtcgcagttgctccggatcccacaagctgtcgtggacatggtggcgggggcccactggggagtcctggcgggccttgcctactattccatggtagggaactgggctaaggttctgattgtggcgctactctttgccggcgttgacggggagacccacacgacggggagggtggccggccacaccacctccgggttcacgtcccttttctcatctggggcgtctcagaaaatccagcttgtgaataccaacggcagctggcacatcaacaggactgccctaaattgcaatgactccctccaaactgggttctttgccgcgctgttttacgcacacaagttcaactcgtccgggtgcccggagcgcatggccagctgccgccccattgactggttcgcccaggggtggggccccatcacctatactaagcctaacagctcggatcagaggccttattgctggcattacgcgcctcgaccgtgtggtgtcgtacccgcgtcgcaggtgtgtggtccagtgtattgtttcaccccaagccctgttgtggtggggaccaccgatcgttccggtgtccctacgtatagctggggggagaatgagacagacgtgatgctcctcaacaacacgcgtccgccacaaggcaactggttcggctgtacatggatgaatagtactgggttcactaagacgtgcggaggtcccccgtgtaacatcgggggggtcggtaaccgcaccttgatctgccccacggactgcttccggaagcaccccgaggctacttacacaaaatgtggctcggggccctggttgacacctaggtgcctagtagactacccatacaggctttggcactacccctgcactctcaatttttccatctttaaggttaggatgtatgtggggggcgtggagcacaggctcaatgccgcatgcaattggactcgaggagagcgctgtaacttggaggacagggataggtcagaactcagcccgctgctgctgtctacaacagagtggcagatactgccctgtgctttcaccaccctaccggctttatccactggtttgatccatctccatcagaacatcgtggacgtgcaatacctgtacggtgtagggtcagcgtttgtctcctttgcaatcaaatgggagtacatcctgttgcttttccttctcctggcagacgcgcgcgtgtgtgcctgcttgtggatgatgctgctgatagcccaggctgaggccgccttagagaacttggtggtcctcaatgcggcgtccgtggccggagcgcatggtattctctcctttcttgtgttcttctgcgccgcctggtacattaagggcaggctggctcctggggcggcgtatgctttttatggcgtatggccgctgctcctgctcctactggcgttaccaccacgagcttacgccttggaccgggagatggctgcatcgtgcgggggtgcggttcttgtaggtctggtattcttgaccttgtcaccatactacaaagtgtttctcactaggctcatatggtggttacaatactttatcaccagagccgaggcgcacatgcaagtgtgggtcccccccctcaacgttcggggaggccgcgatgccatcatcctcctcacgtgtgcggttcatccagagttaattcttgacatcaccaaactcctgctcgccatactcggcccgctcatggtgctccaggctggcataacgagagtgccgtacttcgtgcgcgctcaagggctcattcgtgcatgcatgttagtgcgaaaagtcgccgggggtcattatgtccaaatggtcttcatgaagctgggcgcgctgacaggtacgtacgtttataaccatcttaccccactgcgggactgggcccacgcgggcctacgagaccttgcggtggcggtagagcccgtcgtcttctccgccatggagaccaaggtcatcacctggggagcagacaccgctgcgtgtggggacatcatcttgggtctacccgtctccgcccgaagggggaaggagatatttttgggaccggctgatagtctcgaagggcaagggtggcgactccttgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagactgggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacctatgacgtggacatggtcgatgccaacctgctcatggagggcggtgtggctcagacagagcctgagtccagggtgcccgttctggactttctcgagccaatggccgaggaagagagcgaccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 23 - DNA, 9678 bp, Hepatitis C virus
acccgcccctaataggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacctatgacgtggacatggtcgatgccaacctgctcatggagggcggtgtggctcagacagagcctgagtccagggtgcccgttctggactttctcgagccaatggccgaggaagagagcgaccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 24 - DNA, 9679 bp, Hepatitis C virus
gcccgccccctgatgggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattaccggaaagactgggtcctttcttggataaacccactctatgtccggtcatttgggcacgcccccgcaagactgctagccgagtagcgttgggttgcgaaaggccttgtggtactgcctgatagggtgcttgcgagtgccccgggaggtctcgtagaccgtgcatcatgagcacaaatcctaaacctcaaagaaaaaccaaaagaaacacaaaccgccgcccacaggacgttaagttcccgggtggcggtcagatcgttggcggagtttacttgctgccgcgcaggggccccaggttgggtgtgcgcgcgacaaggaagacttctgagcgatcccagccgcgtggacgacgccagcccatcccgaaagatcggcgctccaccggcaagtcctggggaaagccaggatatccttggcccctgtacggaaacgagggttgcggctgggcgggttggctcctgtccccccgcgggtctcgtcctacttggggccccaccgacccccggcatagatcacgcaatttgggcagagtcatcgataccattacgtgtggttttgccgacctcatggggtacatccctgtcgttggcgccccggttggaggcgtcgccagagctctggcacacggtgttagggtcctggaggacgggataaattacgcaacagggaatttacccggttgctctttttctatctttttgcttgctcttctgtcatgcgtcacagtgccagtgtctgcagtggaagtcaggaacattagttctagctactacgccactaatgattgctcaaacaacagcatcacctggcagctcactgacgcagttctccatcttcctggatgcgtcccatgtgagaatgataatggcaccttgcattgctggatacaagtaacacccaacgtggctgtgaaacaccgcggtgcgctcactcgtagcctgcgaacacacgtcgacatgatcgtaatggcagctacggcctgctcggccttgtatgtgggagatgtgtgcggggccgtgatgattctatcgcaggctttcatggtatcaccacaacgccacaacttcacccaagagtgcaactgttccatctaccaaggtcacatcaccggccatcgcatggcatgggacatgatgctgaactggtctccaactcttgccatgatcctcgcctacgccgctcgtgttcccgagatggtcctcgaaattattttcggcggccattggggtgtggtgtttggcttggcctacttctccatgcaaggagcgtgggccaaagtcattgccatcctccttcttgttgcgggagtggatgcaaccacctattccagcggccaggaagcgggtcgtaccgtcttggggttcactaacctctttacttctggtgccaagcagaacctctatttaatcaacaccaatggcagctggcacataaaccggactgccctcaattgcaatgacagcttacagacgggtttcatggcttccctgttttacacccacaggttcaacagctctggctgccccgagcgcttgtcttcctgccgcgggctggacgattttcgcatcggctggggaaccttggaatacgaaacccacgtcaccaacgatgaggacatgaggccgtactgctggcattaccctccgaggccttgcggcatcgtcccggctagaacggtttgcggaccggtctattgtttcacccctagccctgttgtcgtgggcaccactgacaagcagggcgtacccacctacacctggggggaaaacgagaccgatgtcttcctgctgaatagcacaagacccccgcgaggagcttggttcggctgcacttggatgaacgggactgggttcactaagacatgcggtgcaccaccttgccgcattaggaaagactacaacagcactatcgatttattgtgccccacagactgttttaggaagcaccccgatgctacctatcttaagtgtggagcagggccttggttaactcccaggtgcctggtagactacccttatagactgtggcattatccgtgcactgtaaacttcaccatctttaaggcgcggatgtatgtaggaggggtggagcatcgattctccgcagcatgcaacttcacgcgcggagatcgctgcagactggaagatagggataggggtcagcagagtccactgctgcattccactactgagtgggcggtgctcccatgctccttctctgacctaccagcactatccactggcctattgcacctccaccaaaacatcgtggacgtgcagtacctttacggactttctccggctctgacaagatacatcgtgaagtgggagtgggtgatcctccttttcttgttgttggcagacgccaggatctgtgcatgcctttggatgctcatcatactgggccaagccgaagcggcgcttgagaagctcatcatcttgcactccgctagtgctgctagtgccaatggtccgctgtggtttttcatcttctttacagcggcctggtacttaaagggcagggtggtccccgtggccacgtactctgttctcggcttatggtccttcctcctcctagtcctggccttaccacagcaggcttatgccttggacgctgctgaacaaggggaactggggctggccatattagtaattatatccatctttactcttaccccagcatacaagatcctcctgagccgttcagtgtggtggctgtcctacatgctggtcttggccgaggcccagattcagcaatgggttccccccctggaggtccgaggggggcgtgacggaatcatctgggtggctgtcattctacacccacgccttgtgtttgaggtcacgaaatggttgttagcaatcctggggcctgcctacctccttaaagcgtctctgctacggataccgtactttgtgagggcccacgctttgctacgagtgtgtaccctggtgaaacacctcgcgggggctaggtacatccagatgctgttgatcaccataggcagatggaccggcacttacatctacgaccacctctcccctttatcaacttgggcggcccagggtttgcgggacctggcaatcgccgtggagcctgtggtgttcagcccaatggagaagaaggtcattgtgtggggggctgagacagtggcgtgtggagacatcctgcatggcctcccggtctccgcgaggctaggtagggaggttctgctcggccctgccgacggctacacctccaaggggtggaagctcctagctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacctatgacgtggacatggtcgatgccaacctgctcatggagggcggtgtggctcagacagagcctgagtccagggtgcccgttctggactttctcgagccaatggccgaggaagagagcgaccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 25 - DNA, 9683 bp, Hepatitis C virus
gcctgcctcttacgaggcgacactccaccatggatcactcccctgtgaggaacttctgtcttcacgcggaaagcgcctagccatggcgttagtacgagtgtcgtgcagcctccaggaccccccctcccgggagagccatagtggtctgcggaaccggtgagtacaccggaatcgctggggtgaccgggtcctttcttggagcaacccgctcaatacccagaaatttgggcgtgcccccgcgagatcactagccgagtagtgttgggtcgcgaaaggccttgtggtactgcctgatagggtgcttgcgagtgccccgggaggtctcgtagaccgtgcaacatgagcacacttcctaaacctcaaagaaaaaccaaaagaaacaccatccgtcgcccacaggacgttaagttcccgggtggcggacagatcgttggtggagtatacgtgttgccgcgcaggggcccacgattgggtgtgcgcgcgacgcgtaaaacttctgaacggtcacagcctcgcggacgacgacagcctatccccaaggcgcgtcggagcgaaggccggtcctgggctcagcccgggtacccttggcccctctatggtaatgagggctgcgggtgggcagggtggctcctgtccccgcgcggctcccgtccatcttggggcccaaacgacccccggcggaggtcccgcaatttgggtaaagtcatcgatacccttacgtgcggattcgccgacctcatggggtacatcccgctcgtcggcgctcccgtaggaggcgtcgcaagagccctcgcgcatggcgtgagggcccttgaagacgggataaattttgcaacagggaacttgcccggttgctccttttctatcttccttcttgctctgttctcctgcttagttcatcctgcagctagtcttgagtggcggaatacgtctggcctctatgtccttaccaacgactgttccaatagcagtattgtgtatgaggccgatgacgtcattctgcacacacccggctgtgtaccttgtgttcaggacgacaatacatccacgtgctggaccccagtgacacctacggtggcagtcaggtacgtcggagcaaccaccgcttcgatacgcagtcatgtggacctattagtgggcgcggccacgctgtgctctgcgctctatgtgggtgatatgtgtggggccgtctttctcgtgggacaagccttcacgttcagacctcgtcgccatcaaacggtccagacctgtaactgctcgctgtacccaggccatgtttcaggacatcgaatggcttgggatatgatgatgaattggtcccccgctgtgggtatggtggtggcgcacatcctgcgattgccccagaccttgtttgacatactggccggggcccattggggcatcttggcgggcctagcctattattctatgcagggcaactgggccaaggtcgctattgtcatgattatgttttcaggggtcgatgctgaaacatatgtcaccggtggcagtgtagctcatagtgccagagggttaactagcctttttagtatgggcgccaagcagaaactgcaattggtcaacaccaatggctcgtggcacatcaacagtactgccctgaactgcaatgagtccataaacaccgggttcatagctgggttgttttattaccataagttcaactctactggatgtcctcaaaggcttagcagctgcaagcccatcatttccttcaggcaggggtggggccccttgacagatgctaacatcaccggtccttctgatgatagaccgtattgctggcactacgcacctagaccttgtagtgttgtcccggcatcaagtgtctgcggccctgtgtactgcttcacaccatcgccagtggtcgtaggcactactgatatcaaaggcaagccgacctacaactggggtgagaatgagacagatgtgttcctgctggagtccctgcggcctcccagtggccggtggtttggatgcgcgtggatgaactccacggggttcctcaagacgtgtggagctcccccttgtaacatctatgggggtgagggggatcccgaaaatgagacagacctcttctgccccaccgactgcttcaggaaacatcctgaggccacatacagccggtgtggtgcggggccctggttgacacctcgctgcatggtcgactatccataccggctttggcattacccatgtacagtcaatttcacattgttcaaggtgaggatgtttgtgggcggatttgaacaccggtttaccgccgcttgtaactggaccaggggggagcgctgcaatatcgaggatcgtgatcgcagcgagcaacatccgctgctgcattcaacaactgagcttgctatactgccttgctctttcacgcccatgcctgcattgtcaacaggtctaatacacctccaccaaaatatcgtggatgtccaatacctttatggtgttggatctgacatggtgggatgggcgctgaaatgggagttcgtcatcctcgttttcctcctcctggcagacgcacgcgtgtgcgttgccctttggctgatgctgatggtatcacaagcagaagcagccttggagaaccttgtcacgctgaacgccgtcgctgctgctgggacacatggtattggttggtacctggtagccttttgcgcggcgtggtacgtgcggggtaaacttgtcccgctgacgagctacggcctgacgggtctttggtccctagcattgcttgtcctcttgctcccccaacgggcgtatgcttggtcgggtgaagacagcgctactctcggcgctggggtcttggccctcttcggcttctttaccttatcaccctggtacaagcattggatcggccgcctcatgtggtggaaccagtacactatatgtagatgcgaggccgcccttcaagtgtgggtcccccccttacttgcacgcgggagtagggacggtgtcatcctgctaacaagcttgctttatccatccttaatttttgacatcactaagctgctgatagcagtaataggcccattatacttaatacaggctgccatcactaccaccccctactttgtgcgcgcacatgtactggtccgcctttgcatgctcgtgcgctccgtgatggggggaaagtacttccagatggccatactgagcattggcagatggttcaacacctacctatatgaccacctagcgccaatgcaacattgggccgcagctggcctcaaagacctagcagtggccactgaacctgtaatatttagtcccatggaaattaaggtcatcacctggggcgcggacacagcggcttgcggagatattctttgcgggctgccggtctccgcgcgattaggccgtgaggtattgttgggacctgctgatgattatcgggaaatgggttggcgtctgttggctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagcaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacctatgacgtggacatggtcgatgccaacctgctcatggagggcggtgtggctcagacagagcctgagtccagggtgcccgttctggactttctcgagccaatggccgaggaagagagcgaccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 26 - DNA, 9666 bp, Hepatitis C virus
acctgctctctatgagagcaacactccaccatgaaccgctcccctgtgaggaactactgtcttcacgcagaaagcgtctagccatggcgttagtatgagtgttgtacagcctccaggaccccccctcccgggagagccatagtggtctgcggaaccggtgagtacaccggaatcgccgggatgaccgggtcctttcttggattaacccgctcaatgcccggaaatttgggcgtgcccccgcaagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccaatggacgttaagttcccgggtggtggccagatcgttggcggagtttacttgttgccgcgcaggggccccagattgggtgtgcgcgcgactcggaagacttcggagcggtcgcaacctcgtggaagacgccaacctatccccaaggcgcgtcgacccgagggaaggtcctgggcacaaccaggatatccatggcctctttacggtaatgagggttgtgggtgggcaggatggctcttgtccccccgtggctctcgaccgtcttggggcccaaatgatccccggcggaggtcccgcaatttgggtaaggtcatcgataccctaacctgcggcttcgccgacctcatgggatacatcccgctcgtaggcgcccccgtgggtggcgtcgccagggccctggcacatggtgtcagggctttggaggacgggatcaattatgcaacagggaatctccccggttgctccttttctatcttcctcttggcacttctttcgtgcctgactgtccccgcttcggccgttaactatcgcaatgtctcgggcatctaccatgtcaccaatgactgcccgaattcaagcatagtgtatgaggccgaccatcacatcttgcaccttccaggttgcgtgccctgcgtgagagaggggaatcagtcacgctgctgggtggcccttactcctaccgtcgcagcgccatacatcggcgcaccgcttgagtccttacggagtcatgtggatttgatggtgggggccgccactgtttgctcgggtctttacatcggggacctgtgtggcggcttgttcctagttggccagatgttttcattccgaccacggcgccactggaccacccaggattgcaattgttccatctacacagggcacattacaggccacagaatggcctgggacatgatgatgaactggagtccaacaaccaccttagttctcgcccaggtcatgaggatcccaaccactctggtagacttactctctggaggccactggggtgtcctcgtgggagtggcctatttcagcatgcaggccaattgggccaaagtcatcttggtcctattcctctttgcaggggttgatgccgagactcacgtgtctggggcagcagtcggccggagtaccgccggcttggctaacctcttttcttctgggtctaagcagaatttacagctcatcaacagcaatgggagctggcatataaataggactgcccttaactgcaatgacagcttaaacactgggttcttggctagcttgttctacacccacaagtttaacagctcagggtgttccgaacggctcgcgtgctgcaagagccttgacagctacggccaaggctggggcccactcggggtcgctaacatcagcggctcgtctgatgacaggccttattgctggcactacgcgcctcggccgtgcgggattgtgccagcatccagtgtgtgtggccccgtgtattgtttcactcccagccctgtcgtggtcggtactactgatcacgtcggggtccctacttacacctggggggagaatgagactgatgtcttccttttgaactcgaccagaccgccgcatggtgcgtggtttggatgcgtgtggatgaacagtaccgggttcaccaaaacctgtggcgcccctccatgcgaggttaacaccaataatgggacctggcactgccccaccgattgcttcaggaagcatccggagactacctacgccaagtgcggatcagggccttggatcacaccgcgctgcctgattgattacccgtaccggctgtggcatttcccgtgcaccgccaacttctccgtctttaacatcaggacatttgtcggcggtatagagcatcggatgcaagcggcatgcaactggaccaggggggaagtctgtggcttggagcacagggatcgcgtagagctatcacccctgctccttaccactacagcgtggcagatcctcccctgctctttcaccactttacctgccctctccaccggcttgatccacctccaccaaaatatcgtggacgtccagtacctctatggtgttgggtctgcagtggtatcttgggcccttaagtgggaatatgtggtgctcgcgttcctgcttctcgcggacgcgagagtctctgcctgcctatggatgatgtttatggtaagtcaagttgaggcggctctgtccaacctgattaacatcaatgctgcttcagccgctggtgcccaaggcttctggtacgccatcctcttcatctgcattgtctggcatgtcaagggccggttcccagctgctgctgcctacgcagcctgcgggctgtggcccctgtttctcctgcttctgatgctgcctgagagggcttatgcatacgaccaggaagtggcagggtcccttggcggcgccatcgttgtcatgctggccattctgacactgtctccgcactacaagttatggctggctaggggattgtggtggatccaatattttatagctaggaccgaggctgtgctgcatgtctatattccatccttcaacgtgcgcgggcctcgcgactcagtgattgttcttgcagtcctggtctgtccacacctagtatttgacatcacaaaatatcttctggccatcttagggcccctccacatactccaggcctcgctcctacgcatcccttactttgtgagggcacaagcgctggttaagatctgcagcttgttgcgtggggtagtttatggcaagtacttccaaatggtcgtgcttaaagcaggggccctgactggtacttacatctatgaccaccttactcccatgtcagattgggccgctacgggcctccgcgatttggcggtggccctagagccagttgtgttctcgcccatggagaagaaagtcatcgtctggggcgctgacaccgctgcgtgcggagacatcataaggggattacctgtttcggccaggttgggcaatgaaatcttgctcggaccagccgatacagaaacatcaaaggggtggagactccttgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacctatgacgtggacatggtcgatgccaacctgctcatggagggcggtgtggctcagacagagcctgagtccagggtgcccgttctggactttctcgagccaatggccgaggaagagagcgaccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 27 - DNA, 9668 bp, Hepatitis C virus
acccgccccttattggggcgacactccaccatgatcactcccctgtgaggaactactgtcttcacgcagaaagcgtctagccatggcgttagtatgagtgtcgaacagcctccaggaccccccctcccgggagagccatagtggtctgcggaaccggtgagtacaccggaattgccgggatgaccgggtcctttcttggataaacccgctcaatgcccggagatttgggcgtgcccccgcgagactgctagccgagtagtgttgggtcgcgaaaggccttgtggtactgcctgatagggtgcttgcgagtgccccgggaggtctcgtagaccgtgcaacatgagcacgaatcctaaacctcaaagaaaaaccaaaagaaacaccaaccgccgcccacaggacgtcaagttcccgggcggtggtcagatcgttggtggagtttacttgttgccgcgcaggggccctaggttgggtgtgcgcgcaactcggaagacttcagaacggtcgcaaccccgtggacggcgtcagcctatccccaaggcgcgccagcccacgggccggtcctggggtcaacccgggtacccttggcccctttatgccaatgagggcctcgggtgggcagggtggttgctctccccccgaggctctcggcctaattggggccccaatgacccccggcggaaatcgcgcaacttgggtaaggtcatcgataccctgacgtgcggattcgccgacctcatggggtacatcccgctcgtaggcggccccgttgggggcgtcgcaagggctctcgcacacggtgtgagggtccttgaggacggggtaaactatgcaacagggaatttacccggttgctctttctctatctttatccttgcacttctttcatgcctgactgtcccgacctctgccgttccctaccgaaatgcctctggggtttatcatgtcaccaatgattgcccaaactcttctatcgtctatgaggctgaagacctgatcttacacgcacctggttgcgtgccctgtgttaggcagggtaatgtcagtaggtgctgggtccagatcacccccacactgtcagccccgagcctcggagcggtcacggctcctcttcggagggccgttgactacttagcggggggggctgccctttgctccgcgttatacgtcggagacgcgtgcggggcagtgtttttggtaggtcaaatgttcacctatagccctcgccggcataatgttgtgcaggactgcaactgttccatttacagtggccacatcaccggccaccggatggcatgggacatgatgatgaattggtcacctacaacagctttggtgatggcccagttgttacggattccccaggtggtcattgacatcattgccggggcccactggggggtcttgttcgccgccgcatactacgcgtcggcggctaactgggccaaggttgtgctggtcctgtttctgtttgcgggggtcgatgccagcacccgcactgtgggtggtagtgcggcccaaggcgcgcgcgggctcgcttcacttttcacccctgggccgcagcagaacttgcagctcataaataccaacgggagctggcacatcaacagaactgcccttaactgtaatgacagcctccagactgggtttgtagccggcctcctgtattatcacaagttcaactccactgggtgtccgcagcggatggctagctgtaggcccctcgccgcattcgaccagggctggggaactatcagctatgccgccgtgtcgggccccagtgatgacaagccctattgctggcactaccccccacgcccgtgcggaatagtgccagcgcgaggtgtctgcggtccggtctattgttttacacctagcccggtggtcgtcggcaccacagaccgcaaggggaatcccacttacagttggggcgaaaatgagactgacatctttctcttgaacaacacgaggccccctactggcaactggtttggctgcacctggatgaattccacagggtttgtcaagacttgcggggctccaccctgcaacttagggcctacaggcaacaatagccttaagtgtcctactgattgcttccgcaagcacccagacgccacctacaccaagtgtgggtcaggaccctggctcactccccggtgtctggtgcattacccttaccggttgtggcattacccgtgcaccctaaattacaccatcttcaaggtgcgcatgtacattgggggcctcgagcacaggctcgaggtggcatgcaactggacccgtggtgagcggtgtgatcttgaagacagggatagggccgagctgagcccgctcctacataccaccacgcagtgggccatattgccgtgctctttcacacccacacccgctcttagcactggtctcatacacttacatcaaaatatagtagacacccagtatctttacggtctgagctccagcatcgtctcgtgggccgttaagtgggagtacatagtgctggccttcttattacttgctgatgcccgtatttgtacttgcctatggatcatgctcctggtttgtcaggccgaagcggccctggagaacgtcattgtcctaaacgcggctgcggctgcggggactcatgggtttttctggggcctgctcgtcatctgcttcgcctggcacttcaagggcaggttggtccctggggccacctacctttgcttgggcatttggccattactcttactccttttcctcctgccccaaagggctctagccctggactcaagcgatggcgggactgtgggttgtcttgtgttaaccatccttacaatcttcacactcacccccgggtacaagaagatggtagtgttggtcatatggtggcttcagtatttcatagcccgggtagaggcctttatccatgtgtgggtgcccccgttgcaggttaggggtggtcgtgatgctattatcatgctcacatgccttttccatcctgccctggggtttgaggtcacgaaaatcctcctcgggatactaggtcctttgtacctgctgcagtactcgctcatcaagctgccttatttcatcagggcgcgcgccctgctgagggcgtgcctgctagcgaagcacttggcctgtggcaggtacgtgcaggcggccttgctccaccttggtaggctgaccggaacgtacatttatgaccaccttgcccccatgaaggattgggcagcgtccgggctgcgcgacttagcagtggccacggagcccatcatattctcccctatggagacgaaggtcatcacgtggggggctgacacggccgcatgtggggacatacttgccggccttcctgtatcagctaggcgaggccatgaaatcttcctggggccagccgatgacatcagagaggggggctggcgacttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaggtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacctatgacgtggacatggtcgatgccaacctgctcatggagggcggtgtggctcagacagagcctgagtccagggtgcccgttctggactttctcgagccaatggccgaggaagagagcgaccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 28 - DNA, 9686 bp, Hepatitis C virus
gccagccccttaacggggcgacactccgccattatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccaggatgaccgggtcctttccattggatcaaacccgctcaatgcctggagatttgggcgtgcccccgcaagactgctagccgagtagcgttgggttgcgaaaggccttgtggtactgcctgatagggtgcttgcgagtgccccgggaggtctcgtagaccgtgcatcatgagcacacttccaaaaccccaaagaaaaaccaaaagaaacaccaaccgtcgcccaatggacgtcaagttcccgggtggcggtcagatcgttggcggagtttacttgttgccgcgcaggggcccccggttgggtgtgcgcgcgacgaggaagacttccgagcgatcccagcccagaggcaggcgccaacctataccaaaggcgcgccagccccagggcaggcactgggctcagcccggatatccttggcccctttatgggaacgagggctgtgggtgggcaggttggctcctgtccccccgcggctcccggccacactggggccccaacgacccccggcgtcgatcccggaatttgggtaaggtcatcgataccctaacgtgtgggttcgccgatctcatggggtacattcccgtcgtgggcgcgcctttgggcggcgtcgcggctgcactcgcacatggtgtgagggcaatcgaggacgggatcaattatgcaacagggaatcttcccggttgctctttctctatcttcctcttggcactactctcgtgcctcacaacgccagcgtcggctcttacctacggtaactccagtgggctataccatcttacaaatgattgccccaactccagcatcgtgctggaggcggatgccatgatcttgcatttgcctggatgcttgccttgtgtgagggtcaataacaaccagtccatctgttggcatgctgtgtcccccaccctagccataccaaatgcttccacacctgcaacgggattccgtaggcatgtggaccttcttgcgggcgccgcagtggtttgctcatccctgtacatcggggatctgtgcggctccctctttttggcagggcaactatttacctttcagccccgccgtcactggactgtgcaagactgcaactgctccatttatacaggccacgtcaccggccacaggatggcttgggacatgatgatgaattggtcacccacaaccactctggtcctatctagtatcttgagggtacctgagatctgtgcgagtgtgatatctggtggccattgggggatactactagccgttgcctactttggtatggctggcaactggctaaaagttctggctgtcctgttcttatttgcaggggttgaagcaaccaccaccatcggccatcaagtaggccgcactactggtggcttagccagtctcttctccatcggtcccaggcaaaatctacaactcatcaacaccactggcagctggcatataaacaggactgctctgaactgcaatgattccctccagacggggttcataacgtcactcttttatgccaagaacgtcaactcctcgggctgcccagagcggatggctgcgtgtaagcccctcgcggacttccggcaggggtggggccaaataacctacaaagtcaacatctcgggcccctccgacgaccgtccctactgttggcattacgctcccaggccatgtgacgtggtgtcggcccgcacggtgtgcggccccgtttactgcttcacgcccagccctgtcgtagtaggaaccactgacaagctgggcattcccacatacaactggggggagaatgagacggatgtgttcatgttggaaagccttcggcctcctactggaggatggtttgggtgcacgtggatgaactctacgggctttaccaagacctgtggtgccccgccatgtcagatagtcccgggagattacaatagctctgccaatgagcttttgtgccccaccgactgcttccgtaaacatccggaagctacatatcagcggtgtggatcgggaccctggatcacacctaggtgtctggtggattacccctacaggctgtggcactacccctgtactgtcaacttcaccttgcataaagtcaggatgttcgtgggaggcattgagcatcggtttgacgccgcatgtaactggaccagaggcgagcggtgtgatctacatgacagagacaggattgaaatgagcccgctgcttttctcaactacgcagcttgccatacttccctgttcattttccaccatgccggccttgtcaaccggcctcatccacctgcatcagaacatagtggacgtgcagtacctctacggagtctcctcgagcgttacctcgtgggtggtgaagtgggagtacattgttctggtgttcctggttctggcagatgctcggatttgtacatgtctctggttaatgctgctcataaccaacgttgaagcagcagtggaaaggcttgtcgtcctcaatgcggctagcgccgccggcaccgccggctggtggtgggcggtgctcttcctgtgctgtgcttggtacgtgaaaggccgccttgtgcctgcgtgtacctacatggcactgggaatgtggccgttgctcctgacaatcttggccctgcctcgccgagcatacgctatggacaatgagcaagcggcatccctcggagctgttggtctcttggtgctcaccatctttaccatcacccccatgtacaagaagctgttgacctgctccatttggtggaatcagtatttcctcgcccgagctgaggccatgatacacgagtgggtgcccgacctacgggttaggggcggtagggactccatcatcttacttacctgcttgttacatccacagctggggtttgaggtcaccaaaattctactagccatcctggcccctctatacatcctgcagtacagtttgctcaaggtgccttactttgtgcgcgcccacgtactcctgcgtgcttgcctgcttgttcgtaggctagcagggggtaagtacgtgcaggcgtgccttctgaggttgggcgcttggactggcacctttgtctatgaccatctcgcccctctctctgactgggctagcgacggactgcgcgatttggcagtcgcaatcgagccggtcattttctctcccatggagaagaaaatcattacctggggtgcggataccgccgcgtgtggtgacatcttgagtggcctcccggtgtcagcgaggttggggaatttggtgctactgggacccgcggacgatatgcagcgcgggggttggaagcttttggctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacctatgacgtggacatggtcgatgccaacctgctcatggagggcggtgtggctcagacagagcctgagtccagggtgcccgttctggactttctcgagccaatggccgaggaagagagcgaccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 29 - protein, 3029 aa, Hepatitis C virus
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSSGLYHVTNDCPNSSIVYEAADAILHTPGCVPCVREGNASRCWVAVTPTVATRDGKLPTTQLRRHIDLLVGSATLCSALYVGDLCGSVFLVGQLFTFSPRRHWTTQDCNCSIYPGHITGHRMAWDMMMNWSPTAALVVAQLLRIPQAIMDMIAGAHWGVLAGIAYFSMVGNWAKVLVVLLLFAGVDAETHVTGGNAGRTTAGLVGLLTPGAKQNIQLINTNGSWHINSTALNCNESLNTGWLAGLFYQHKFNSSGCPERLASCRRLTDFAQGWGPISYANGSGLDERPYCWHYPPRPCGIVPAKSVCGPVYCFTPSPVVVGTTDRSGAPTYSWGANDTDVFVLNNTRPPLGNWFGCTWMNSTGFTKVCGAPPCVIGGVGNNTLLCPTDCFRKHPEATYSRCGSGPWITPRCMVDYPYRLWHYPCTINYTIFKVRMYVGGVEHRLEAACNWTRGERCDLEDRDRSELSPLLLSTTQWQVLPCSFTTLPALSTGLIHLHQNIVDVQYLYGVGSSIASWAIKWEYVVLLFLLLADARVCSCLWMMLLISQAEAALENLVILNAASLAGTHGLVSFLVFFCFAWYLKGRWVPGAAYALYGMWPLLLLLLALPQRAYALDTEVAASCGGVVLVGLMALTLSPYYKRYISWCMWWLQYFLTRVEAQLHVWVPPLNVRGGRDAVILLMCVVHPTLVFDITKLLLAIFGPLWILQASLLKVPYFVRVQGLLRICALARKIAGGHYVQMAIIKLGALTGTYVYNHLTPLRDWAHNGLRDLAVAVEPVVFSRMETKLITWGADTAACGDIINGLPVSARRGQEILLGPADGMVSKGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAALGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTYDVDMVDANLLMEGGVAQTEPESRVPVLDFLEPMAEEESDLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 30 - protein, 3029 aa, Hepatitis C virus
MSTNPKPQRKTKRNTNRRPQDVKFPGGGQIVGGVYLLPRRGPRLGVRATRKASERSQPRGRRQPIPKARRPEGRAWAQPGYPWPLYGNEGLGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTIPASAYEVRNVSGIYHVTNDCSNSSIVYEAADVIMHTPGCVPCVQEGNSSRCWVALTPTLAARNASVPTTTIRRHVDLLVGTAAFCSAMYVGDLCGSIFLVSQLFTFSPRRHETVQDCNCSIYPGHVSGHRMAWDMMMNWSPTTALVVSQLLRIPQAVVDMVAGAHWGVLAGLAYYSMVGNWAKVLIVALLFAGVDGETHTTGRVAGHTTSGFTSLFSSGASQKIQLVNTNGSWHINRTALNCNDSLQTGFFAALFYAHKFNSSGCPERMASCRPIDWFAQGWGPITYTKPNSSDQRPYCWHYAPRPCGVVPASQVCGPVYCFTPSPVVVGTTDRSGVPTYSWGENETDVMLLNNTRPPQGNWFGCTWMNSTGFTKTCGGPPCNIGGVGNRTLICPTDCFRKHPEATYTKCGSGPWLTPRCLVDYPYRLWHYPCTLNFSIFKVRMYVGGVEHRLNAACNWTRGERCNLEDRDRSELSPLLLSTTEWQILPCAFTTLPALSTGLIHLHQNIVDVQYLYGVGSAFVSFAIKWEYILLLFLLLADARVCACLWMMLLIAQAEAALENLVVLNAASVAGAHGILSFLVFFCAAWYIKGRLAPGAAYAFYGVWPLLLLLLALPPRAYALDREMAASCGGAVLVGLVFLTLSPYYKVFLTRLIWWLQYFITRAEAHMQVWVPPLNVRGGRDAIILLTCAVHPELILDITKLLLAILGPLMVLQAGITRVPYFVRAQGLIRACMLVRKVAGGHYVQMVFMKLGALTGTYVYNHLTPLRDWAHAGLRDLAVAVEPVVFSAMETKVITWGADTAACGDIILGLPVSARRGKEIFLGPADSLEGQGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRLGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTYDVDMVDANLLMEGGVAQTEPESRVPVLDFLEPMAEEESDLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 31 - protein, 3033 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTYDVDMVDANLLMEGGVAQTEPESRVPVLDFLEPMAEEESDLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 32 - protein, 3033 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGCGWAGWLLSPRGSRPTWGPTDPRHRSRNLGRVIDTITCGFADLMGYIPVVGAPVGGVARALAHGVRVLEDGINYATGNLPGCSFSIFLLALLSCVTVPVSAVEVRNISSSYYATNDCSNNSITWQLTDAVLHLPGCVPCENDNGTLHCWIQVTPNVAVKHRGALTRSLRTHVDMIVMAATACSALYVGDVCGAVMILSQAFMVSPQRHNFTQECNCSIYQGHITGHRMAWDMMLNWSPTLAMILAYAARVPEMVLEIIFGGHWGVVFGLAYFSMQGAWAKVIAILLLVAGVDATTYSSGQEAGRTVLGFTNLFTSGAKQNLYLINTNGSWHINRTALNCNDSLQTGFMASLFYTHRFNSSGCPERLSSCRGLDDFRIGWGTLEYETHVTNDEDMRPYCWHYPPRPCGIVPARTVCGPVYCFTPSPVVVGTTDKQGVPTYTWGENETDVFLLNSTRPPRGAWFGCTWMNGTGFTKTCGAPPCRIRKDYNSTIDLLCPTDCFRKHPDATYLKCGAGPWLTPRCLVDYPYRLWHYPCTVNFTIFKARMYVGGVEHRFSAACNFTRGDRCRLEDRDRGQQSPLLHSTTEWAVLPCSFSDLPALSTGLLHLHQNIVDVQYLYGLSPALTRYIVKWEWVILLFLLLADARICACLWMLIILGQAEAALEKLIILHSASAASANGPLWFFIFFTAAWYLKGRVVPVATYSVLGLWSFLLLVLALPQQAYALDAAEQGELGLAILVIISIFTLTPAYKILLSRSVWWLSYMLVLAEAQIQQWVPPLEVRGGRDGIIWVAVILHPRLVFEVTKWLLAILGPAYLLKASLLRIPYFVRAHALLRVCTLVKHLAGARYIQMLLITIGRWTGTYIYDHLSPLSTWAAQGLRDLAIAVEPVVFSPMEKKVIVWGAETVACGDILHGLPVSARLGREVLLGPADGYTSKGWKLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTYDVDMVDANLLMEGGVAQTEPESRVPVLDFLEPMAEEESDLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 33 - protein, 3035 aa, Hepatitis C virus
MSTLPKPQRKTKRNTIRRPQDVKFPGGGQIVGGVYVLPRRGPRLGVRATRKTSERSQPRGRRQPIPKARRSEGRSWAQPGYPWPLYGNEGCGWAGWLLSPRGSRPSWGPNDPRRRSRNLGKVIDTLTCGFADLMGYIPLVGAPVGGVARALAHGVRALEDGINFATGNLPGCSFSIFLLALFSCLVHPAASLEWRNTSGLYVLTNDCSNSSIVYEADDVILHTPGCVPCVQDDNTSTCWTPVTPTVAVRYVGATTASIRSHVDLLVGAATLCSALYVGDMCGAVFLVGQAFTFRPRRHQTVQTCNCSLYPGHVSGHRMAWDMMMNWSPAVGMVVAHILRLPQTLFDILAGAHWGILAGLAYYSMQGNWAKVAIVMIMFSGVDAETYVTGGSVAHSARGLTSLFSMGAKQKLQLVNTNGSWHINSTALNCNESINTGFIAGLFYYHKFNSTGCPQRLSSCKPIISFRQGWGPLTDANITGPSDDRPYCWHYAPRPCSVVPASSVCGPVYCFTPSPVVVGTTDIKGKPTYNWGENETDVFLLESLRPPSGRWFGCAWMNSTGFLKTCGAPPCNIYGGEGDPENETDLFCPTDCFRKHPEATYSRCGAGPWLTPRCMVDYPYRLWHYPCTVNFTLFKVRMFVGGFEHRFTAACNWTRGERCNIEDRDRSEQHPLLHSTTELAILPCSFTPMPALSTGLIHLHQNIVDVQYLYGVGSDMVGWALKWEFVILVFLLLADARVCVALWLMLMVSQAEAALENLVTLNAVAAAGTHGIGWYLVAFCAAWYVRGKLVPLTSYGLTGLWSLALLVLLLPQRAYAWSGEDSATLGAGVLALFGFFTLSPWYKHWIGRLMWWNQYTICRCEAALQVWVPPLLARGSRDGVILLTSLLYPSLIFDITKLLIAVIGPLYLIQAAITTTPYFVRAHVLVRLCMLVRSVMGGKYFQMAILSIGRWFNTYLYDHLAPMQHWAAAGLKDLAVATEPVIFSPMEIKVITWGADTAACGDILCGLPVSARLGREVLLGPADDYREMGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKQKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTYDVDMVDANLLMEGGVAQTEPESRVPVLDFLEPMAEEESDLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 34 - protein, 3029 aa, Hepatitis C virus
MSTNPKPQRKTKRNTNRRPMDVKFPGGGQIVGGVYLLPRRGPRLGVRATRKTSERSQPRGRRQPIPKARRPEGRSWAQPGYPWPLYGNEGCGWAGWLLSPRGSRPSWGPNDPRRRSRNLGKVIDTLTCGFADLMGYIPLVGAPVGGVARALAHGVRALEDGINYATGNLPGCSFSIFLLALLSCLTVPASAVNYRNVSGIYHVTNDCPNSSIVYEADHHILHLPGCVPCVREGNQSRCWVALTPTVAAPYIGAPLESLRSHVDLMVGAATVCSGLYIGDLCGGLFLVGQMFSFRPRRHWTTQDCNCSIYTGHITGHRMAWDMMMNWSPTTTLVLAQVMRIPTTLVDLLSGGHWGVLVGVAYFSMQANWAKVILVLFLFAGVDAETHVSGAAVGRSTAGLANLFSSGSKQNLQLINSNGSWHINRTALNCNDSLNTGFLASLFYTHKFNSSGCSERLACCKSLDSYGQGWGPLGVANISGSSDDRPYCWHYAPRPCGIVPASSVCGPVYCFTPSPVVVGTTDHVGVPTYTWGENETDVFLLNSTRPPHGAWFGCVWMNSTGFTKTCGAPPCEVNTNNGTWHCPTDCFRKHPETTYAKCGSGPWITPRCLIDYPYRLWHFPCTANFSVFNIRTFVGGIEHRMQAACNWTRGEVCGLEHRDRVELSPLLLTTTAWQILPCSFTTLPALSTGLIHLHQNIVDVQYLYGVGSAVVSWALKWEYVVLAFLLLADARVSACLWMMFMVSQVEAALSNLININAASAAGAQGFWYAILFICIVWHVKGRFPAAAAYAACGLWPLFLLLLMLPERAYAYDQEVAGSLGGAIVVMLAILTLSPHYKLWLARGLWWIQYFIARTEAVLHVYIPSFNVRGPRDSVIVLAVLVCPHLVFDITKYLLAILGPLHILQASLLRIPYFVRAQALVKICSLLRGVVYGKYFQMVVLKAGALTGTYIYDHLTPMSDWAATGLRDLAVALEPVVFSPMEKKVIVWGADTAACGDIIRGLPVSARLGNEILLGPADTETSKGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTYDVDMVDANLLMEGGVAQTEPESRVPVLDFLEPMAEEESDLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 35 - protein, 3030 aa, Hepatitis C virus
MSTNPKPQRKTKRNTNRRPQDVKFPGGGQIVGGVYLLPRRGPRLGVRATRKTSERSQPRGRRQPIPKARQPTGRSWGQPGYPWPLYANEGLGWAGWLLSPRGSRPNWGPNDPRRKSRNLGKVIDTLTCGFADLMGYIPLVGGPVGGVARALAHGVRVLEDGVNYATGNLPGCSFSIFILALLSCLTVPTSAVPYRNASGVYHVTNDCPNSSIVYEAEDLILHAPGCVPCVRQGNVSRCWVQITPTLSAPSLGAVTAPLRRAVDYLAGGAALCSALYVGDACGAVFLVGQMFTYSPRRHNVVQDCNCSIYSGHITGHRMAWDMMMNWSPTTALVMAQLLRIPQVVIDIIAGAHWGVLFAAAYYASAANWAKVVLVLFLFAGVDASTRTVGGSAAQGARGLASLFTPGPQQNLQLINTNGSWHINRTALNCNDSLQTGFVAGLLYYHKFNSTGCPQRMASCRPLAAFDQGWGTISYAAVSGPSDDKPYCWHYPPRPCGIVPARGVCGPVYCFTPSPVVVGTTDRKGNPTYSWGENETDIFLLNNTRPPTGNWFGCTWMNSTGFVKTCGAPPCNLGPTGNNSLKCPTDCFRKHPDATYTKCGSGPWLTPRCLVHYPYRLWHYPCTLNYTIFKVRMYIGGLEHRLEVACNWTRGERCDLEDRDRAELSPLLHTTTQWAILPCSFTPTPALSTGLIHLHQNIVDTQYLYGLSSSIVSWAVKWEYIVLAFLLLADARICTCLWIMLLVCQAEAALENVIVLNAAAAAGTHGFFWGLLVICFAWHFKGRLVPGATYLCLGIWPLLLLLFLLPQRALALDSSDGGTVGCLVLTILTIFTLTPGYKKMVVLVIWWLQYFIARVEAFIHVWVPPLQVRGGRDAIIMLTCLFHPALGFEVTKILLGILGPLYLLQYSLIKLPYFIRARALLRACLLAKHLACGRYVQAALLHLGRLTGTYIYDHLAPMKDWAASGLRDLAVATEPIIFSPMETKVITWGADTAACGDILAGLPVSARRGHEIFLGPADDIREGGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTRSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTYDVDMVDANLLMEGGVAQTEPESRVPVLDFLEPMAEEESDLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 36 - protein, 3035 aa, Hepatitis C virus
MSTLPKPQRKTKRNTNRRPMDVKFPGGGQIVGGVYLLPRRGPRLGVRATRKTSERSQPRGRRQPIPKARQPQGRHWAQPGYPWPLYGNEGCGWAGWLLSPRGSRPHWGPNDPRRRSRNLGKVIDTLTCGFADLMGYIPVVGAPLGGVAAALAHGVRAIEDGINYATGNLPGCSFSIFLLALLSCLTTPASALTYGNSSGLYHLTNDCPNSSIVLEADAMILHLPGCLPCVRVNNNQSICWHAVSPTLAIPNASTPATGFRRHVDLLAGAAVVCSSLYIGDLCGSLFLAGQLFTFQPRRHWTVQDCNCSIYTGHVTGHRMAWDMMMNWSPTTTLVLSSILRVPEICASVISGGHWGILLAVAYFGMAGNWLKVLAVLFLFAGVEATTTIGHQVGRTTGGLASLFSIGPRQNLQLINTTGSWHINRTALNCNDSLQTGFITSLFYAKNVNSSGCPERMAACKPLADFRQGWGQITYKVNISGPSDDRPYCWHYAPRPCDVVSARTVCGPVYCFTPSPVVVGTTDKLGIPTYNWGENETDVFMLESLRPPTGGWFGCTWMNSTGFTKTCGAPPCQIVPGDYNSSANELLCPTDCFRKHPEATYQRCGSGPWITPRCLVDYPYRLWHYPCTVNFTLHKVRMFVGGIEHRFDAACNWTRGERCDLHDRDRIEMSPLLFSTTQLAILPCSFSTMPALSTGLIHLHQNIVDVQYLYGVSSSVTSWVVKWEYIVLVFLVLADARICTCLWLMLLITNVEAAVERLVVLNAASAAGTAGWWWAVLFLCCAWYVKGRLVPACTYMALGMWPLLLTILALPRRAYAMDNEQAASLGAVGLLVLTIFTITPMYKKLLTCSIWWNQYFLARAEAMIHEWVPDLRVRGGRDSIILLTCLLHPQLGFEVTKILLAILAPLYILQYSLLKVPYFVRAHVLLRACLLVRRLAGGKYVQACLLRLGAWTGTFVYDHLAPLSDWASDGLRDLAVAIEPVIFSPMEKKIITWGADTAACGDILSGLPVSARLGNLVLLGPADDMQRGGWKLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTYDVDMVDANLLMEGGVAQTEPESRVPVLDFLEPMAEEESDLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 37 - DNA, 9667 bp, Hepatitis C virus
gccagccccctgatgggggcgacactccaccatgaatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggataaacccgctcaatgcctggagatttgggcgtgcccccgcaagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaaggcttccgagcggtcgcaacctcgtggaaggcgacaacctatcccaaaggctcgccgacccgagggcagggcctgggctcagcccgggtacccttggcccctctatggcaatgagggcctggggtgggcaggatggctcctgtcaccccgcggctcccggcctagttggggccccacggacccccggcgtaggtcgcgtaacttgggtaaggtcatcgatacccttacatgcggcttcgccgatctcatggggtacattccgctcgtcggcgcccccctagggggcgctgccagggccttggcacacggtgtccgggttctggaggacggcgtgaactatgcaacagggaacttgcccggttgctctttctctatcttcctcttggctctgctgtcctgtttgaccatcccagcttccgcttatgaagtgcgcaacgtgtccgggatataccatgtcacgaacgactgctccaactcaagcattgtgtatgaggcagcggacgtgatcatgcatactcccgggtgcgtgccctgtgttcaggagggtaacagctcccgttgctgggtagcgctcactcccacgctcgcggccaggaatgccagcgtccccactacgacaatacgacgccacgtcgacttgctcgttgggacggctgctttctgctccgctatgtacgtgggggatctctgcggatctattttcctcgtctcccagctgttcaccttctcgcctcgccggcatgagacagtgcaggactgcaactgctcaatctatcccggccatgtatcaggtcaccgcatggcttgggatatgatgatgaactggtcacctacaacagccctagtggtgtcgcagttgctccggatcccacaagctgtcgtggacatggtggcgggggcccactggggagtcctggcgggccttgcctactattccatggtagggaactgggctaaggttctgattgtggcgctactctttgccggcgttgacggggagacccacacgacggggagggtggccggccacaccacctccgggttcacgtcccttttctcatctggggcgtctcagaaaatccagcttgtgaataccaacggcagctggcacatcaacaggactgccctaaattgcaatgactccctccaaactgggttctttgccgcgctgttttacgcacacaagttcaactcgtccgggtgcccggagcgcatggccagctgccgccccattgactggttcgcccaggggtggggccccatcacctatactaagcctaacagctcggatcagaggccttattgctggcattacgcgcctcgaccgtgtggtgtcgtacccgcgtcgcaggtgtgtggtccagtgtattgtttcaccccaagccctgttgtggtggggaccaccgatcgttccggtgtccctacgtatagctggggggagaatgagacagacgtgatgctcctcaacaacacgcgtccgccacaaggcaactggttcggctgtacatggatgaatagtactgggttcactaagacgtgcggaggtcccccgtgtaacatcgggggggtcggtaaccgcaccttgatctgccccacggactgcttccggaagcaccccgaggctacttacacaaaatgtggctcggggccctggttgacacctaggtgcctagtagactacccatacaggctttggcactacccctgcactctcaatttttccatctttaaggttaggatgtatgtggggggcgtggagcacaggctcaatgccgcatgcaattggactcgaggagagcgctgtaacttggaggacagggataggtcagaactcagcccgctgctgctgtctacaacagagtggcagatactgccctgtgctttcaccaccctaccggctttatccactggtttgatccatctccatcagaacatcgtggacgtgcaatacctgtacggtgtagggtcagcgtttgtctcctttgcaatcaaatgggagtacatcctgttgcttttccttctcctggcagacgcgcgcgtgtgtgcctgcttgtggatgatgctgctgatagcccaggctgaggccgccttagagaacttggtggtcctcaatgcggcgtccgtggccggagcgcatggtattctctcctttcttgtgttcttctgcgccgcctggtacattaagggcaggctggctcctggggcggcgtatgctttttatggcgtatggccgctgctcctgctcctactggcgttaccaccacgagcttacgccttggaccgggagatggctgcatcgtgcgggggtgcggttcttgtaggtctggtattcttgaccttgtcaccatactacaaagtgtttctcactaggctcatatggtggttacaatactttatcaccagagccgaggcgcacatgcaagtgtgggtcccccccctcaacgttcggggaggccgcgatgccatcatcctcctcacgtgtgcggttcatccagagttaattcttgacatcaccaaactcctgctcgccatactcggcccgctcatggtgctccaggctggcataacgagagtgccgtacttcgtgcgcgctcaagggctcattcgtgcatgcatgttagtgcgaaaagtcgccgggggtcattatgtccaaatggtcttcatgaagctgggcgcgctgacaggtacgtacgtttataaccatcttaccccactgcgggactgggcccacgcgggcctacgagaccttgcggtggcggtagagcccgtcgtcttctccgccatggagaccaaggtcatcacctggggagcagacaccgctgcgtgtggggacatcatcttgggtctacccgtctccgcccgaagggggaaggagatatttttgggaccggctgatagtctcgaagggcaagggtggcgactccttgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagactgggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacctatgacgtggacatggtcgatgccaacctgctcatggagggcggtgtggctcagacagagcctgagtccagggtgcccgttctggactttctcgagccaatggccgaggaagagagcgaccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 38 - DNA, 9679 bp, Hepatitis C virus
gccagccccctgatgggggcgacactccaccatgaatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggataaacccgctcaatgcctggagatttgggcgtgcccccgcaagactgctagccgagtagtgttgggtcgcgaaaggccttgtggtactgcctgatagggtgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacctatgacgtggacatggtcgatgccaacctgctcatggagggcggtgtggctcagacagagcctgagtccagggtgcccgttctggactttctcgagccaatggccgaggaagagagcgaccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 39 - DNA, 9679 bp, Hepatitis C virus
gccagccccctgatgggggcgacactccaccatgaatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggataaacccgctcaatgcctggagatttgggcgtgcccccgcaagactgctagccgagtagtgttgggtcgcgaaaggccttgtggtactgcctgatagggtgcttgcgagtgccccgggaggtctcgtagaccgtgcaccatgagcacaaatcctaaacctcaaagaaaaaccaaaagaaacacaaaccgccgcccacaggacgttaagttcccgggtggcggtcagatcgttggcggagtttacttgctgccgcgcaggggccccaggttgggtgtgcgcgcgacaaggaagacttctgagcgatcccagccgcgtggacgacgccagcccatcccgaaagatcggcgctccaccggcaagtcctggggaaagccaggatatccttggcccctgtacggaaacgagggttgcggctgggcgggttggctcctgtccccccgcgggtctcgtcctacttggggccccaccgacccccggcatagatcacgcaatttgggcagagtcatcgataccattacgtgtggttttgccgacctcatggggtacatccctgtcgttggcgccccggttggaggcgtcgccagagctctggcacacggtgttagggtcctggaggacgggataaattacgcaacagggaatttacccggttgctctttttctatctttttgcttgctcttctgtcatgcgtcacagtgccagtgtctgcagtggaagtcaggaacattagttctagctactacgccactaatgattgctcaaacaacagcatcacctggcagctcactgacgcagttctccatcttcctggatgcgtcccatgtgagaatgataatggcaccttgcattgctggatacaagtaacacccaacgtggctgtgaaacaccgcggtgcgctcactcgtagcctgcgaacacacgtcgacatgatcgtaatggcagctacggcctgctcggccttgtatgtgggagatgtgtgcggggccgtgatgattctatcgcaggctttcatggtatcaccacaacgccacaacttcacccaagagtgcaactgttccatctaccaaggtcacatcaccggccatcgcatggcatgggacatgatgctgaactggtctccaactcttgccatgatcctcgcctacgccgctcgtgttcccgagatggtcctcgaaattattttcggcggccattggggtgtggtgtttggcttggcctacttctccatgcaaggagcgtgggccaaagtcattgccatcctccttcttgttgcgggagtggatgcaaccacctattccagcggccaggaagcgggtcgtaccgtcttggggttcactaacctctttacttctggtgccaagcagaacctctatttaatcaacaccaatggcagctggcacataaaccggactgccctcaattgcaatgacagcttacagacgggtttcatggcttccctgttttacacccacaggttcaacagctctggctgccccgagcgcttgtcttcctgccgcgggctggacgattttcgcatcggctggggaaccttggaatacgaaacccacgtcaccaacgatgaggacatgaggccgtactgctggcattaccctccgaggccttgcggcatcgtcccggctagaacggtttgcggaccggtctattgtttcacccctagccctgttgtcgtgggcaccactgacaagcagggcgtacccacctacacctggggggaaaacgagaccgatgtcttcctgctgaatagcacaagacccccgcgaggagcttggttcggctgcacttggatgaacgggactgggttcactaagacatgcggtgcaccaccttgccgcattaggaaagactacaacagcactatcgatttattgtgccccacagactgttttaggaagcaccccgatgctacctatcttaagtgtggagcagggccttggttaactcccaggtgcctggtagactacccttatagactgtggcattatccgtgcactgtaaacttcaccatctttaaggcgcggatgtatgtaggaggggtggagcatcgattctccgcagcatgcaacttcacgcgcggagatcgctgcagactggaagatagggataggggtcagcagagtccactgctgcattccactactgagtgggcggtgctcccatgctccttctctgacctaccagcactatccactggcctattgcacctccaccaaaacatcgtggacgtgcagtacctttacggactttctccggctctgacaagatacatcgtgaagtgggagtgggtgatcctccttttcttgttgttggcagacgccaggatctgtgcatgcctttggatgctcatcatactgggccaagccgaagcggcgcttgagaagctcatcatcttgcactccgctagtgctgctagtgccaatggtccgctgtggtttttcatcttctttacagcggcctggtacttaaagggcagggtggtccccgtggccacgtactctgttctcggcttatggtccttcctcctcctagtcctggccttaccacagcaggcttatgccttggacgctgctgaacaaggggaactggggctggccatattagtaattatatccatctttactcttaccccagcatacaagatcctcctgagccgttcagtgtggtggctgtcctacatgctggtcttggccgaggcccagattcagcaatgggttccccccctggaggtccgaggggggcgtgacggaatcatctgggtggctgtcattctacacccacgccttgtgtttgaggtcacgaaatggttgttagcaatcctggggcctgcctacctccttaaagcgtctctgctacggataccgtactttgtgagggcccacgctttgctacgagtgtgtaccctggtgaaacacctcgcgggggctaggtacatccagatgctgttgatcaccataggcagatggaccggcacttacatctacgaccacctctcccctttatcaacttgggcggcccagggtttgcgggacctggcaatcgccgtggagcctgtggtgttcagcccaatggagaagaaggtcattgtgtggggggctgagacagtggcgtgtggagacatcctgcatggcctcccggtctccgcgaggctaggtagggaggttctgctcggccctgccgacggctacacctccaaggggtggaagctcctagctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacctatgacgtggacatggtcgatgccaacctgctcatggagggcggtgtggctcagacagagcctgagtccagggtgcccgttctggactttctcgagccaatggccgaggaagagagcgaccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 40 - DNA, 9685 bp, Hepatitis C virus
gccagccccctgatgggggcgacactccaccatgaatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggataaacccgctcaatgcctggagatttgggcgtgcccccgcaagactgctagccgagtagtgttgggtcgcgaaaggccttgtggtactgcctgatagggtgcttgcgagtgccccgggaggtctcgtagaccgtgcaccatgagcacacttcctaaacctcaaagaaaaaccaaaagaaacaccatccgtcgcccacaggacgttaagttcccgggtggcggacagatcgttggtggagtatacgtgttgccgcgcaggggcccacgattgggtgtgcgcgcgacgcgtaaaacttctgaacggtcacagcctcgcggacgacgacagcctatccccaaggcgcgtcggagcgaaggccggtcctgggctcagcccgggtacccttggcccctctatggtaatgagggctgcgggtgggcagggtggctcctgtccccgcgcggctcccgtccatcttggggcccaaacgacccccggcggaggtcccgcaatttgggtaaagtcatcgatacccttacgtgcggattcgccgacctcatggggtacatcccgctcgtcggcgctcccgtaggaggcgtcgcaagagccctcgcgcatggcgtgagggcccttgaagacgggataaattttgcaacagggaacttgcccggttgctccttttctatcttccttcttgctctgttctcctgcttagttcatcctgcagctagtcttgagtggcggaatacgtctggcctctatgtccttaccaacgactgttccaatagcagtattgtgtatgaggccgatgacgtcattctgcacacacccggctgtgtaccttgtgttcaggacgacaatacatccacgtgctggaccccagtgacacctacggtggcagtcaggtacgtcggagcaaccaccgcttcgatacgcagtcatgtggacctattagtgggcgcggccacgctgtgctctgcgctctatgtgggtgatatgtgtggggccgtctttctcgtgggacaagccttcacgttcagacctcgtcgccatcaaacggtccagacctgtaactgctcgctgtacccaggccatgtttcaggacatcgaatggcttgggatatgatgatgaattggtcccccgctgtgggtatggtggtggcgcacatcctgcgattgccccagaccttgtttgacatactggccggggcccattggggcatcttggcgggcctagcctattattctatgcagggcaactgggccaaggtcgctattgtcatgattatgttttcaggggtcgatgctgaaacatatgtcaccggtggcagtgtagctcatagtgccagagggttaactagcctttttagtatgggcgccaagcagaaactgcaattggtcaacaccaatggctcgtggcacatcaacagtactgccctgaactgcaatgagtccataaacaccgggttcatagctgggttgttttattaccataagttcaactctactggatgtcctcaaaggcttagcagctgcaagcccatcatttccttcaggcaggggtggggccccttgacagatgctaacatcaccggtccttctgatgatagaccgtattgctggcactacgcacctagaccttgtagtgttgtcccggcatcaagtgtctgcggccctgtgtactgcttcacaccatcgccagtggtcgtaggcactactgatatcaaaggcaagccgacctacaactggggtgagaatgagacagatgtgttcctgctggagtccctgcggcctcccagtggccggtggtttggatgcgcgtggatgaactccacggggttcctcaagacgtgtggagctcccccttgtaacatctatgggggtgagggggatcccgaaaatgagacagacctcttctgccccaccgactgcttcaggaaacatcctgaggccacatacagccggtgtggtgcggggccctggttgacacctcgctgcatggtcgactatccataccggctttggcattacccatgtacagtcaatttcacattgttcaaggtgaggatgtttgtgggcggatttgaacaccggtttaccgccgcttgtaactggaccaggggggagcgctgcaatatcgaggatcgtgatcgcagcgagcaacatccgctgctgcattcaacaactgagcttgctatactgccttgctctttcacgcccatgcctgcattgtcaacaggtctaatacacctccaccaaaatatcgtggatgtccaatacctttatggtgttggatctgacatggtgggatgggcgctgaaatgggagttcgtcatcctcgttttcctcctcctggcagacgcacgcgtgtgcgttgccctttggctgatgctgatggtatcacaagcagaagcagccttggagaaccttgtcacgctgaacgccgtcgctgctgctgggacacatggtattggttggtacctggtagccttttgcgcggcgtggtacgtgcggggtaaacttgtcccgctgacgagctacggcctgacgggtctttggtccctagcattgcttgtcctcttgctcccccaacgggcgtatgcttggtcgggtgaagacagcgctactctcggcgctggggtcttggccctcttcggcttctttaccttatcaccctggtacaagcattggatcggccgcctcatgtggtggaaccagtacactatatgtagatgcgaggccgcccttcaagtgtgggtcccccccttacttgcacgcgggagtagggacggtgtcatcctgctaacaagcttgctttatccatccttaatttttgacatcactaagctgctgatagcagtaataggcccattatacttaatacaggctgccatcactaccaccccctactttgtgcgcgcacatgtactggtccgcctttgcatgctcgtgcgctccgtgatggggggaaagtacttccagatggccatactgagcattggcagatggttcaacacctacctatatgaccacctagcgccaatgcaacattgggccgcagctggcctcaaagacctagcagtggccactgaacctgtaatatttagtcccatggaaattaaggtcatcacctggggcgcggacacagcggcttgcggagatattctttgcgggctgccggtctccgcgcgattaggccgtgaggtattgttgggacctgctgatgattatcgggaaatgggttggcgtctgttggctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagcaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacctatgacgtggacatggtcgatgccaacctgctcatggagggcggtgtggctcagacagagcctgagtccagggtgcccgttctggactttctcgagccaatggccgaggaagagagcgaccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 41 - DNA, 9667 bp, Hepatitis C virus
gccagccccctgatgggggcgacactccaccatgaatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggataaacccgctcaatgcctggagatttgggcgtgcccccgcaagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccaatggacgttaagttcccgggtggtggccagatcgttggcggagtttacttgttgccgcgcaggggccccagattgggtgtgcgcgcgactcggaagacttcggagcggtcgcaacctcgtggaagacgccaacctatccccaaggcgcgtcgacccgagggaaggtcctgggcacaaccaggatatccatggcctctttacggtaatgagggttgtgggtgggcaggatggctcttgtccccccgtggctctcgaccgtcttggggcccaaatgatccccggcggaggtcccgcaatttgggtaaggtcatcgataccctaacctgcggcttcgccgacctcatgggatacatcccgctcgtaggcgcccccgtgggtggcgtcgccagggccctggcacatggtgtcagggctttggaggacgggatcaattatgcaacagggaatctccccggttgctccttttctatcttcctcttggcacttctttcgtgcctgactgtccccgcttcggccgttaactatcgcaatgtctcgggcatctaccatgtcaccaatgactgcccgaattcaagcatagtgtatgaggccgaccatcacatcttgcaccttccaggttgcgtgccctgcgtgagagaggggaatcagtcacgctgctgggtggcccttactcctaccgtcgcagcgccatacatcggcgcaccgcttgagtccttacggagtcatgtggatttgatggtgggggccgccactgtttgctcgggtctttacatcggggacctgtgtggcggcttgttcctagttggccagatgttttcattccgaccacggcgccactggaccacccaggattgcaattgttccatctacacagggcacattacaggccacagaatggcctgggacatgatgatgaactggagtccaacaaccaccttagttctcgcccaggtcatgaggatcccaaccactctggtagacttactctctggaggccactggggtgtcctcgtgggagtggcctatttcagcatgcaggccaattgggccaaagtcatcttggtcctattcctctttgcaggggttgatgccgagactcacgtgtctggggcagcagtcggccggagtaccgccggcttggctaacctcttttcttctgggtctaagcagaatttacagctcatcaacagcaatgggagctggcatataaataggactgcccttaactgcaatgacagcttaaacactgggttcttggctagcttgttctacacccacaagtttaacagctcagggtgttccgaacggctcgcgtgctgcaagagccttgacagctacggccaaggctggggcccactcggggtcgctaacatcagcggctcgtctgatgacaggccttattgctggcactacgcgcctcggccgtgcgggattgtgccagcatccagtgtgtgtggccccgtgtattgtttcactcccagccctgtcgtggtcggtactactgatcacgtcggggtccctacttacacctggggggagaatgagactgatgtcttccttttgaactcgaccagaccgccgcatggtgcgtggtttggatgcgtgtggatgaacagtaccgggttcaccaaaacctgtggcgcccctccatgcgaggttaacaccaataatgggacctggcactgccccaccgattgcttcaggaagcatccggagactacctacgccaagtgcggatcagggccttggatcacaccgcgctgcctgattgattacccgtaccggctgtggcatttcccgtgcaccgccaacttctccgtctttaacatcaggacatttgtcggcggtatagagcatcggatgcaagcggcatgcaactggaccaggggggaagtctgtggcttggagcacagggatcgcgtagagctatcacccctgctccttaccactacagcgtggcagatcctcccctgctctttcaccactttacctgccctctccaccggcttgatccacctccaccaaaatatcgtggacgtccagtacctctatggtgttgggtctgcagtggtatcttgggcccttaagtgggaatatgtggtgctcgcgttcctgcttctcgcggacgcgagagtctctgcctgcctatggatgatgtttatggtaagtcaagttgaggcggctctgtccaacctgattaacatcaatgctgcttcagccgctggtgcccaaggcttctggtacgccatcctcttcatctgcattgtctggcatgtcaagggccggttcccagctgctgctgcctacgcagcctgcgggctgtggcccctgtttctcctgcttctgatgctgcctgagagggcttatgcatacgaccaggaagtggcagggtcccttggcggcgccatcgttgtcatgctggccattctgacactgtctccgcactacaagttatggctggctaggggattgtggtggatccaatattttatagctaggaccgaggctgtgctgcatgtctatattccatccttcaacgtgcgcgggcctcgcgactcagtgattgttcttgcagtcctggtctgtccacacctagtatttgacatcacaaaatatcttctggccatcttagggcccctccacatactccaggcctcgctcctacgcatcccttactttgtgagggcacaagcgctggttaagatctgcagcttgttgcgtggggtagtttatggcaagtacttccaaatggtcgtgcttaaagcaggggccctgactggtacttacatctatgaccaccttactcccatgtcagattgggccgctacgggcctccgcgatttggcggtggccctagagccagttgtgttctcgcccatggagaagaaagtcatcgtctggggcgctgacaccgctgcgtgcggagacatcataaggggattacctgtttcggccaggttgggcaatgaaatcttgctcggaccagccgatacagaaacatcaaaggggtggagactccttgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacctatgacgtggacatggtcgatgccaacctgctcatggagggcggtgtggctcagacagagcctgagtccagggtgcccgttctggactttctcgagccaatggccgaggaagagagcgaccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 42 - DNA, 9670 bp, Hepatitis C virus
gccagccccctgatgggggcgacactccaccatgaatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggataaacccgctcaatgcctggagatttgggcgtgcccccgcaagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaaagaaacaccaaccgccgcccacaggacgtcaagttcccgggcggtggtcagatcgttggtggagtttacttgttgccgcgcaggggccctaggttgggtgtgcgcgcaactcggaagacttcagaacggtcgcaaccccgtggacggcgtcagcctatccccaaggcgcgccagcccacgggccggtcctggggtcaacccgggtacccttggcccctttatgccaatgagggcctcgggtgggcagggtggttgctctccccccgaggctctcggcctaattggggccccaatgacccccggcggaaatcgcgcaacttgggtaaggtcatcgataccctgacgtgcggattcgccgacctcatggggtacatcccgctcgtaggcggccccgttgggggcgtcgcaagggctctcgcacacggtgtgagggtccttgaggacggggtaaactatgcaacagggaatttacccggttgctctttctctatctttatccttgcacttctttcatgcctgactgtcccgacctctgccgttccctaccgaaatgcctctggggtttatcatgtcaccaatgattgcccaaactcttctatcgtctatgaggctgaagacctgatcttacacgcacctggttgcgtgccctgtgttaggcagggtaatgtcagtaggtgctgggtccagatcacccccacactgtcagccccgagcctcggagcggtcacggctcctcttcggagggccgttgactacttagcggggggggctgccctttgctccgcgttatacgtcggagacgcgtgcggggcagtgtttttggtaggtcaaatgttcacctatagccctcgccggcataatgttgtgcaggactgcaactgttccatttacagtggccacatcaccggccaccggatggcatgggacatgatgatgaattggtcacctacaacagctttggtgatggcccagttgttacggattccccaggtggtcattgacatcattgccggggcccactggggggtcttgttcgccgccgcatactacgcgtcggcggctaactgggccaaggttgtgctggtcctgtttctgtttgcgggggtcgatgccagcacccgcactgtgggtggtagtgcggcccaaggcgcgcgcgggctcgcttcacttttcacccctgggccgcagcagaacttgcagctcataaataccaacgggagctggcacatcaacagaactgcccttaactgtaatgacagcctccagactgggtttgtagccggcctcctgtattatcacaagttcaactccactgggtgtccgcagcggatggctagctgtaggcccctcgccgcattcgaccagggctggggaactatcagctatgccgccgtgtcgggccccagtgatgacaagccctattgctggcactaccccccacgcccgtgcggaatagtgccagcgcgaggtgtctgcggtccggtctattgttttacacctagcccggtggtcgtcggcaccacagaccgcaaggggaatcccacttacagttggggcgaaaatgagactgacatctttctcttgaacaacacgaggccccctactggcaactggtttggctgcacctggatgaattccacagggtttgtcaagacttgcggggctccaccctgcaacttagggcctacaggcaacaatagccttaagtgtcctactgattgcttccgcaagcacccagacgccacctacaccaagtgtgggtcaggaccctggctcactccccggtgtctggtgcattacccttaccggttgtggcattacccgtgcaccctaaattacaccatcttcaaggtgcgcatgtacattgggggcctcgagcacaggctcgaggtggcatgcaactggacccgtggtgagcggtgtgatcttgaagacagggatagggccgagctgagcccgctcctacataccaccacgcagtgggccatattgccgtgctctttcacacccacacccgctcttagcactggtctcatacacttacatcaaaatatagtagacacccagtatctttacggtctgagctccagcatcgtctcgtgggccgttaagtgggagtacatagtgctggccttcttattacttgctgatgcccgtatttgtacttgcctatggatcatgctcctggtttgtcaggccgaagcggccctggagaacgtcattgtcctaaacgcggctgcggctgcggggactcatgggtttttctggggcctgctcgtcatctgcttcgcctggcacttcaagggcaggttggtccctggggccacctacctttgcttgggcatttggccattactcttactccttttcctcctgccccaaagggctctagccctggactcaagcgatggcgggactgtgggttgtcttgtgttaaccatccttacaatcttcacactcacccccgggtacaagaagatggtagtgttggtcatatggtggcttcagtatttcatagcccgggtagaggcctttatccatgtgtgggtgcccccgttgcaggttaggggtggtcgtgatgctattatcatgctcacatgccttttccatcctgccctggggtttgaggtcacgaaaatcctcctcgggatactaggtcctttgtacctgctgcagtactcgctcatcaagctgccttatttcatcagggcgcgcgccctgctgagggcgtgcctgctagcgaagcacttggcctgtggcaggtacgtgcaggcggccttgctccaccttggtaggctgaccggaacgtacatttatgaccaccttgcccccatgaaggattgggcagcgtccgggctgcgcgacttagcagtggccacggagcccatcatattctcccctatggagacgaaggtcatcacgtggggggctgacacggccgcatgtggggacatacttgccggccttcctgtatcagctaggcgaggccatgaaatcttcctggggccagccgatgacatcagagaggggggctggcgacttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaggtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacctatgacgtggacatggtcgatgccaacctgctcatggagggcggtgtggctcagacagagcctgagtccagggtgcccgttctggactttctcgagccaatggccgaggaagagagcgaccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 43 - DNA, 9685 bp, Hepatitis C virus
gccagccccctgatgggggcgacactccaccatgaatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggataaacccgctcaatgcctggagatttgggcgtgcccccgcaagactgctagccgagtagtgttgggtcgcgaaaggccttgtggtactgcctgatagggtgcttgcgagtgccccgggaggtctcgtagaccgtgcaccatgagcacacttccaaaaccccaaagaaaaaccaaaagaaacaccaaccgtcgcccaatggacgtcaagttcccgggtggcggtcagatcgttggcggagtttacttgttgccgcgcaggggcccccggttgggtgtgcgcgcgacgaggaagacttccgagcgatcccagcccagaggcaggcgccaacctataccaaaggcgcgccagccccagggcaggcactgggctcagcccggatatccttggcccctttatgggaacgagggctgtgggtgggcaggttggctcctgtccccccgcggctcccggccacactggggccccaacgacccccggcgtcgatcccggaatttgggtaaggtcatcgataccctaacgtgtgggttcgccgatctcatggggtacattcccgtcgtgggcgcgcctttgggcggcgtcgcggctgcactcgcacatggtgtgagggcaatcgaggacgggatcaattatgcaacagggaatcttcccggttgctctttctctatcttcctcttggcactactctcgtgcctcacaacgccagcgtcggctcttacctacggtaactccagtgggctataccatcttacaaatgattgccccaactccagcatcgtgctggaggcggatgccatgatcttgcatttgcctggatgcttgccttgtgtgagggtcaataacaaccagtccatctgttggcatgctgtgtcccccaccctagccataccaaatgcttccacacctgcaacgggattccgtaggcatgtggaccttcttgcgggcgccgcagtggtttgctcatccctgtacatcggggatctgtgcggctccctctttttggcagggcaactatttacctttcagccccgccgtcactggactgtgcaagactgcaactgctccatttatacaggccacgtcaccggccacaggatggcttgggacatgatgatgaattggtcacccacaaccactctggtcctatctagtatcttgagggtacctgagatctgtgcgagtgtgatatctggtggccattgggggatactactagccgttgcctactttggtatggctggcaactggctaaaagttctggctgtcctgttcttatttgcaggggttgaagcaaccaccaccatcggccatcaagtaggccgcactactggtggcttagccagtctcttctccatcggtcccaggcaaaatctacaactcatcaacaccactggcagctggcatataaacaggactgctctgaactgcaatgattccctccagacggggttcataacgtcactcttttatgccaagaacgtcaactcctcgggctgcccagagcggatggctgcgtgtaagcccctcgcggacttccggcaggggtggggccaaataacctacaaagtcaacatctcgggcccctccgacgaccgtccctactgttggcattacgctcccaggccatgtgacgtggtgtcggcccgcacggtgtgcggccccgtttactgcttcacgcccagccctgtcgtagtaggaaccactgacaagctgggcattcccacatacaactggggggagaatgagacggatgtgttcatgttggaaagccttcggcctcctactggaggatggtttgggtgcacgtggatgaactctacgggctttaccaagacctgtggtgccccgccatgtcagatagtcccgggagattacaatagctctgccaatgagcttttgtgccccaccgactgcttccgtaaacatccggaagctacatatcagcggtgtggatcgggaccctggatcacacctaggtgtctggtggattacccctacaggctgtggcactacccctgtactgtcaacttcaccttgcataaagtcaggatgttcgtgggaggcattgagcatcggtttgacgccgcatgtaactggaccagaggcgagcggtgtgatctacatgacagagacaggattgaaatgagcccgctgcttttctcaactacgcagcttgccatacttccctgttcattttccaccatgccggccttgtcaaccggcctcatccacctgcatcagaacatagtggacgtgcagtacctctacggagtctcctcgagcgttacctcgtgggtggtgaagtgggagtacattgttctggtgttcctggttctggcagatgctcggatttgtacatgtctctggttaatgctgctcataaccaacgttgaagcagcagtggaaaggcttgtcgtcctcaatgcggctagcgccgccggcaccgccggctggtggtgggcggtgctcttcctgtgctgtgcttggtacgtgaaaggccgccttgtgcctgcgtgtacctacatggcactgggaatgtggccgttgctcctgacaatcttggccctgcctcgccgagcatacgctatggacaatgagcaagcggcatccctcggagctgttggtctcttggtgctcaccatctttaccatcacccccatgtacaagaagctgttgacctgctccatttggtggaatcagtatttcctcgcccgagctgaggccatgatacacgagtgggtgcccgacctacgggttaggggcggtagggactccatcatcttacttacctgcttgttacatccacagctggggtttgaggtcaccaaaattctactagccatcctggcccctctatacatcctgcagtacagtttgctcaaggtgccttactttgtgcgcgcccacgtactcctgcgtgcttgcctgcttgttcgtaggctagcagggggtaagtacgtgcaggcgtgccttctgaggttgggcgcttggactggcacctttgtctatgaccatctcgcccctctctctgactgggctagcgacggactgcgcgatttggcagtcgcaatcgagccggtcattttctctcccatggagaagaaaatcattacctggggtgcggataccgccgcgtgtggtgacatcttgagtggcctcccggtgtcagcgaggttggggaatttggtgctactgggacccgcggacgatatgcagcgcgggggttggaagcttttggctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacctatgacgtggacatggtcgatgccaacctgctcatggagggcggtgtggctcagacagagcctgagtccagggtgcccgttctggactttctcgagccaatggccgaggaagagagcgaccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 44 - DNA, 9679 bp, Hepatitis C virus
gccagccccctgatgggggcgacactccaccatgaatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggataaacccgctcaatgcctggagatttgggcgtgcccccgcaagactgctagccgagtagtgttgggtcgcgaaaggccttgtggtactgcctgatagggtgcttgcgagtgccccgggaggtctcgtagaccgtgcaccatgagcacgaatcctaaacctcaaagattaaccaaaagaaacaccgtccgtcgcccacagaacgttaagttcccgggtggcgggcagatcgttggcggagtctacttgttgccgcgcaggggccctagattgggtgtgcgcggcactaggaagagttcggagcgatcgcagcccaggggaagacgccaacgtatccccaaagctgcctcttcacagggtaaagcctggggcaagcccgggtacccttggcccctgtatggtaacgagggctgtggctgggcagggtggctcctgtccccccgcggctctcgacctacttggggccccactgacccccggcaccgctcgcgaaacctcggtaaggtgatcgacaccatgacctgcgggtttgccgacctcatggggtacatccctgtcctaggcgcccccctagggggcgttgccagggctctggcacatggtgttagagttctggaggacggggtcaactatgcaacagggaacttgcctggttgctccttttctatcttcttactagccctcctgtcatgtctaacagtcccggcatcggcttatgaagtccgcaactccagtggggtctatcatctcaccaatgactgccccaacgctagtatagtctatgaaacagacaacgccatcctacacgagcctgggtgcgtgccttgcgttcgcgagggtaatactagcaggtgttgggaaccagtggcccccactttggcggtccgctatcgcggagcgcttactgacgatttgcggacgcatattgacctagtggtggcgtcagctaccctgtgctccgccttgtacgtgggggacatttgtggagccatcttcattgccagccaagctgttctctggaagcccggggggggtcggatagtgcaagattgcaattgttcgatctacccgggccacgtcaccggccacaggatggcgtgggacatgatgcagaactgggcgccggccttgtcaatggttgccgcttacgctgtgagagtgcccggtgtcatcattaccactgtagcgggcggccactggggtgtgttatttggcctcgcttactttggtatggcgggaaactgggcaaaggtaatactcatcatgctactcatgtccggcgtcgacgcggaaaccatggccgtcggggctagggccgctcacaccactggcgcccttgtcagcctgctcaatccagggcccagtcagcgcctgcagctgatcaacaccaatgggtcatggcacatcaaccggaccgctttgaactgcaatgactctttgcagacagggttcatagcggccctcttctacacacataggttcaattctagtggctgtcccgagaggatggcttcttgtaaacctctcagtgactttgaccaggggtggggcccgctgtggtacaattcaacagaaagaccttcggaccagcgaccctattgctggcactacgcgccatcgccgtgtggtattgtgccggctaaggatgtttgcggtccggtctactgctttacaccaagcccggttgtggtgggcaccacggatcgccggggggtgcccacgtatacttggggtgaaaatgagtctgatgtcttcctgctcaacagcacaaggccgccgcaaggcagttggtttgggtgctcatggatgaacacaacggggttcacgaagacctgcggaggtcctccgtgcaagatacgtccccagggtgcccagagtaacacctctctcacttgtcccacagactgcttcaggaaacatccgcgtgccacatactccgcttgcggatctggtccgtggttgacacctagatgcatggtccattacccctatagactgtggcactacccgtgtacagtcaacttcaccatacacaaagtcaggttatacatagggggtgtagaacataggctcgatgcagcgtgcaattggacgcggggtgagcgatgcgacctggaggaccgagacagggtggacatgtcccccctgctccattccactacggagctcgcaatacttccgtgttcctttgtgccgcttccggccttatctacgggactgatccacctgcaccaaaacatcgttgacgcccagtacctttatggtctttctcccgctataataagctgggccatcagatgggagtgggtagtcctcgttttcctactcctggcggacgcgcggatctgcgcctgcctttggatgatgatgcttatggcccaggctgaagccgctctggagaacttgatccacctcaacgcggccagccttgcgggaacccatggtatctggtggctccttttagtcttttgtgcctcttggcatctacgaggcagggttgtccctctggtgacgtatgggatatgcgggatgtggcccttcttcctcatgttgctgagcctccccccacgagcgtatgctctggacagggaagtgagcgcagcgttgggaacgggcatgctcgccatcatcctattagttaccttgggaccgcactacaagagacttctagcccttattctctggtgggtcacatatttccttacaaggtgtgaagcagcactccaaacgtgggtccctcctctcaaccctcgggggggcagggacggtttcatcctgtgtgtgctgctgtgctatccaggccttgtctttgacatcacaaaatggttgctggtcatgatgtgccctctctacctcctccagttgtgtttggtgaggactccatactttgtgagggcccaggccctcatcagagtgtgttctctcttcaaaacgctagctgggggacggtacgtgcaggccgcgctgctcactattggccgctggaccggcacttatatttataaccatctcgcccccctggaaacatgggccgccggcggcctacgggatttggccgttgcagtcgagcccgtgatattctcccccatggagaagaagatcatagtttggggggcggagaccactgcttgtggcgacattctttgtggcctgcctgtctcagctcggctcggcagggaagtcctgctagggcccgcggatgactacaggtccatgggatggcaactcctggctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacctatgacgtggacatggtcgatgccaacctgctcatggagggcggtgtggctcagacagagcctgagtccagggtgcccgttctggactttctcgagccaatggccgaggaagagagcgaccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 45 - DNA, 9665 bp, Hepatitis C virus
gcctgcctcttacgaggcgacactccaccatggatcactcccctgtgaggaacttctgtcttcacgcggaaagcgcctagccatggcgttagtacgagtgtcgtgcagcctccaggaccccccctcccgggagagccatagtggtctgcggaaccggtgagtacaccggaatcgctggggtgaccgggtcctttcttggagcaacccgctcaatacccagaaatttgggcgtgcccccgcgagatcactagccgagtagtgttgggtcgcgaaaggccttgtggtactgcctgatagggtgcttgcgagtgccccgggaggtctcgtagaccgtgcaacatgagcacgaatcctaaacctcaaagaaaaaccaaacgtaacaccaaccgtcgcccacaggacgtcaagttcccgggtggcggtcagatcgttggtggagtttacttgttgccgcgcaggggccctagattgggtgtgcgcgcgacgaggaagacttccgagcggtcgcaacctcgaggtagacgtcagcctatccccaaggcacgtcggcccgagggcaggacctgggctcagcccgggtacccttggcccctctatggcaatgagggttgcgggtgggcgggatggctcctgtctccccgtggctctcggcctagctggggccccacagacccccggcgtaggtcgcgcaatttgggtaaggtcatcgatacccttacgtgcggcttcgccgacctcatggggtacataccgctcgtcggcgcccctcttggaggcgctgccagggccctggcgcatggcgtccgggttctggaagacggcgtgaactatgcaacagggaaccttcctggttgctctttctctatcttccttctggccctgctctcttgcctgactgtgcccgcttcagcctaccaagtgcgcaattcctcggggctttaccatgtcaccaatgattgccctaactcgagtattgtgtacgaggcggccgatgccatcctgcacactccggggtgtgtcccttgcgttcgcgagggtaacgcctcgaggtgttgggtggcggtgacccccacggtggccaccagggacggcaaactccccacaacgcagcttcgacgtcatatcgatctgcttgtcgggagcgccaccctctgctcggccctctacgtgggggacctgtgcgggtctgtctttcttgttggtcaactgtttaccttctctcccaggcgccactggacgacgcaagactgcaattgttctatctatcccggccatataacgggtcatcgcatggcatgggatatgatgatgaactggtcccctacggcagcgttggtggtagctcagctgctccggatcccacaagccatcatggacatgatcgctggtgctcactggggagtcctggcgggcatagcgtatttctccatggtggggaactgggcgaaggtcctggtagtgctgctgctatttgccggcgtcgacgcggaaacccacgtcaccgggggaaatgccggccgcaccacggctgggcttgttggtctccttacaccaggcgccaagcagaacatccaactgatcaacaccaacggcagttggcacatcaatagcacggccttgaattgcaatgaaagccttaacaccggctggttagcagggctcttctatcaacacaaattcaactcttcaggctgtcctgagaggttggccagctgccgacgccttaccgattttgcccagggctggggtcctatcagttatgccaacggaagcggcctcgacgaacgcccctactgctggcactaccctccaagaccttgtggcattgtgcccgcaaagagcgtgtgtggcccggtatattgcttcactcccagccccgtggtggtgggaacgaccgacaggtcgggcgcgcctacctacagctggggtgcaaatgatacggatgtcttcgtccttaacaacaccaggccaccgctgggcaattggttcggttgtacctggatgaactcaactggattcaccaaagtgtgcggagcgcccccttgtgtcatcggaggggtgggcaacaacaccttgctctgccccactgattgcttccgcaaacatccggaagccacatactctcggtgcggctccggtccctggattacacccaggtgcatggtcgactacccgtataggctttggcactatccttgtaccatcaattacaccatattcaaagtcaggatgtacgtgggaggggtcgagcacaggctggaagcggcctgcaactggacgcggggcgaacgctgtgatctggaagacagggacaggtccgagctcagcccgttgctgctgtccaccacacagtggcaggtccttccgtgttctttcacgaccctgccagccttgtccaccggcctcatccacctccaccagaacattgtggacgtgcagtacttgtacggggtagggtcaagcatcgcgtcctgggccattaagtgggagtacgtcgttctcctgttccttctgcttgcagacgcgcgcgtctgctcctgcttgtggatgatgttactcatatcccaagcggaggcggctttggagaacctcgtaatactcaatgcagcatccctggccgggacgcacggtcttgtgtccttcctcgtgttcttctgctttgcgtggtatctgaagggtaggtgggtgcccggagcggcctacgccctctacgggatgtggcctctcctcctgctcctgctggcgttgcctcagcgggcatacgcactggacacggaggtggccgcgtcgtgtggcggcgttgttcttgtcgggttaatggcgctgactctgtcgccatattacaagcgctatatcagctggtgcatgtggtggcttcagtattttctgaccagagtagaagcgcaactgcacgtgtgggttccccccctcaacgtccggggggggcgcgatgccgtcatcttactcatgtgtgtagtacacccgaccctggtatttgacatcaccaaactactcctggccatcttcggacccctttggattcttcaagccagtttgcttaaagtcccctacttcgtgcgcgttcaaggccttctccggatctgcgcgctagcgcggaagatagccggaggtcattacgtgcaaatggccatcatcaagttaggggcgcttactggcacctatgtgtataaccatctcacccctcttcgagactgggcgcacaacggcctgcgagatctggccgtggctgtggaaccagtcgtcttctcccgaatggagaccaagctcatcacgtggggggcagataccgccgcgtgcggtgacatcatcaacggcttgcccgtctctgcccgtaggggccaggagatactgcttgggccagccgacggaatggtctccaaggggtggaggttgctggctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgccctggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacctatgacgtggacatggtcgatgccaacctgctcatggagggcggtgtggctcagacagagcctgagtccagggtgcccgttctggactttctcgagccaatggccgaggaagagagcgaccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 46 - DNA, 9665 bp, Hepatitis C virus
gcctgcctcttacgaggcgacactccaccatggatcactcccctgtgaggaacttctgtcttcacgcggaaagcgcctagccatggcgttagtacgagtgtcgtgcagcctccaggaccccccctcccgggagagccatagtggtctgcggaaccggtgagtacaccggaatcgctggggtgaccgggtcctttcttggagcaacccgctcaatacccagaaatttgggcgtgcccccgcgagatcactagccgagtagtgttgggtcgcgaaaggccttgtggtactgcctgatagggtgcttgcgagtgccccgggaggtctcgtagaccgtgcaacatgagcacgaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaaggcttccgagcggtcgcaacctcgtggaaggcgacaacctatcccaaaggctcgccgacccgagggcagggcctgggctcagcccgggtacccttggcccctctatggcaatgagggcctggggtgggcaggatggctcctgtcaccccgcggctcccggcctagttggggccccacggacccccggcgtaggtcgcgtaacttgggtaaggtcatcgatacccttacatgcggcttcgccgatctcatggggtacattccgctcgtcggcgcccccctagggggcgctgccagggccttggcacacggtgtccgggttctggaggacggcgtgaactatgcaacagggaacttgcccggttgctctttctctatcttcctcttggctctgctgtcctgtttgaccatcccagcttccgcttatgaagtgcgcaacgtgtccgggatataccatgtcacgaacgactgctccaactcaagcattgtgtatgaggcagcggacgtgatcatgcatactcccgggtgcgtgccctgtgttcaggagggtaacagctcccgttgctgggtagcgctcactcccacgctcgcggccaggaatgccagcgtccccactacgacaatacgacgccacgtcgacttgctcgttgggacggctgctttctgctccgctatgtacgtgggggatctctgcggatctattttcctcgtctcccagctgttcaccttctcgcctcgccggcatgagacagtgcaggactgcaactgctcaatctatcccggccatgtatcaggtcaccgcatggcttgggatatgatgatgaactggtcacctacaacagccctagtggtgtcgcagttgctccggatcccacaagctgtcgtggacatggtggcgggggcccactggggagtcctggcgggccttgcctactattccatggtagggaactgggctaaggttctgattgtggcgctactctttgccggcgttgacggggagacccacacgacggggagggtggccggccacaccacctccgggttcacgtcccttttctcatctggggcgtctcagaaaatccagcttgtgaataccaacggcagctggcacatcaacaggactgccctaaattgcaatgactccctccaaactgggttctttgccgcgctgttttacgcacacaagttcaactcgtccgggtgcccggagcgcatggccagctgccgccccattgactggttcgcccaggggtggggccccatcacctatactaagcctaacagctcggatcagaggccttattgctggcattacgcgcctcgaccgtgtggtgtcgtacccgcgtcgcaggtgtgtggtccagtgtattgtttcaccccaagccctgttgtggtggggaccaccgatcgttccggtgtccctacgtatagctggggggagaatgagacagacgtgatgctcctcaacaacacgcgtccgccacaaggcaactggttcggctgtacatggatgaatagtactgggttcactaagacgtgcggaggtcccccgtgtaacatcgggggggtcggtaaccgcaccttgatctgccccacggactgcttccggaagcaccccgaggctacttacacaaaatgtggctcggggccctggttgacacctaggtgcctagtagactacccatacaggctttggcactacccctgcactctcaatttttccatctttaaggttaggatgtatgtggggggcgtggagcacaggctcaatgccgcatgcaattggactcgaggagagcgctgtaacttggaggacagggataggtcagaactcagcccgctgctgctgtctacaacagagtggcagatactgccctgtgctttcaccaccctaccggctttatccactggtttgatccatctccatcagaacatcgtggacgtgcaatacctgtacggtgtagggtcagcgtttgtctcctttgcaatcaaatgggagtacatcctgttgcttttccttctcctggcagacgcgcgcgtgtgtgcctgcttgtggatgatgctgctgatagcccaggctgaggccgccttagagaacttggtggtcctcaatgcggcgtccgtggccggagcgcatggtattctctcctttcttgtgttcttctgcgccgcctggtacattaagggcaggctggctcctggggcggcgtatgctttttatggcgtatggccgctgctcctgctcctactggcgttaccaccacgagcttacgccttggaccgggagatggctgcatcgtgcgggggtgcggttcttgtaggtctggtattcttgaccttgtcaccatactacaaagtgtttctcactaggctcatatggtggttacaatactttatcaccagagccgaggcgcacatgcaagtgtgggtcccccccctcaacgttcggggaggccgcgatgccatcatcctcctcacgtgtgcggttcatccagagttaattcttgacatcaccaaactcctgctcgccatactcggcccgctcatggtgctccaggctggcataacgagagtgccgtacttcgtgcgcgctcaagggctcattcgtgcatgcatgttagtgcgaaaagtcgccgggggtcattatgtccaaatggtcttcatgaagctgggcgcgctgacaggtacgtacgtttataaccatcttaccccactgcgggactgggcccacgcgggcctacgagaccttgcggtggcggtagagcccgtcgtcttctccgccatggagaccaaggtcatcacctggggagcagacaccgctgcgtgtggggacatcatcttgggtctacccgtctccgcccgaagggggaaggagatatttttgggaccggctgatagtctcgaagggcaagggtggcgactccttgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagactgggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacctatgacgtggacatggtcgatgccaacctgctcatggagggcggtgtggctcagacagagcctgagtccagggtgcccgttctggactttctcgagccaatggccgaggaagagagcgaccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 47 - DNA, 9677 bp, Hepatitis C virus
gcctgcctcttacgaggcgacactccaccatggatcactcccctgtgaggaacttctgtcttcacgcggaaagcgcctagccatggcgttagtacgagtgtcgtgcagcctccaggaccccccctcccgggagagccatagtggtctgcggaaccggtgagtacaccggaatcgctggggtgaccgggtcctttcttggagcaacccgctcaatacccagaaatttgggcgtgcccccgcgagatcactagccgagtagtgttgggtcgcgaaaggccttgtggtactgcctgatagggtgcttgcgagtgccccgggaggtctcgtagaccgtgcaacatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacctatgacgtggacatggtcgatgccaacctgctcatggagggcggtgtggctcagacagagcctgagtccagggtgcccgttctggactttctcgagccaatggccgaggaagagagcgaccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 48 - DNA, 9677 bp, Hepatitis C virus
gcctgcctcttacgaggcgacactccaccatggatcactcccctgtgaggaacttctgtcttcacgcggaaagcgcctagccatggcgttagtacgagtgtcgtgcagcctccaggaccccccctcccgggagagccatagtggtctgcggaaccggtgagtacaccggaatcgctggggtgaccgggtcctttcttggagcaacccgctcaatacccagaaatttgggcgtgcccccgcgagatcactagccgagtagtgttgggtcgcgaaaggccttgtggtactgcctgatagggtgcttgcgagtgccccgggaggtctcgtagaccgtgcaacatgagcacaaatcctaaacctcaaagaaaaaccaaaagaaacacaaaccgccgcccacaggacgttaagttcccgggtggcggtcagatcgttggcggagtttacttgctgccgcgcaggggccccaggttgggtgtgcgcgcgacaaggaagacttctgagcgatcccagccgcgtggacgacgccagcccatcccgaaagatcggcgctccaccggcaagtcctggggaaagccaggatatccttggcccctgtacggaaacgagggttgcggctgggcgggttggctcctgtccccccgcgggtctcgtcctacttggggccccaccgacccccggcatagatcacgcaatttgggcagagtcatcgataccattacgtgtggttttgccgacctcatggggtacatccctgtcgttggcgccccggttggaggcgtcgccagagctctggcacacggtgttagggtcctggaggacgggataaattacgcaacagggaatttacccggttgctctttttctatctttttgcttgctcttctgtcatgcgtcacagtgccagtgtctgcagtggaagtcaggaacattagttctagctactacgccactaatgattgctcaaacaacagcatcacctggcagctcactgacgcagttctccatcttcctggatgcgtcccatgtgagaatgataatggcaccttgcattgctggatacaagtaacacccaacgtggctgtgaaacaccgcggtgcgctcactcgtagcctgcgaacacacgtcgacatgatcgtaatggcagctacggcctgctcggccttgtatgtgggagatgtgtgcggggccgtgatgattctatcgcaggctttcatggtatcaccacaacgccacaacttcacccaagagtgcaactgttccatctaccaaggtcacatcaccggccatcgcatggcatgggacatgatgctgaactggtctccaactcttgccatgatcctcgcctacgccgctcgtgttcccgagatggtcctcgaaattattttcggcggccattggggtgtggtgtttggcttggcctacttctccatgcaaggagcgtgggccaaagtcattgccatcctccttcttgttgcgggagtggatgcaaccacctattccagcggccaggaagcgggtcgtaccgtcttggggttcactaacctctttacttctggtgccaagcagaacctctatttaatcaacaccaatggcagctggcacataaaccggactgccctcaattgcaatgacagcttacagacgggtttcatggcttccctgttttacacccacaggttcaacagctctggctgccccgagcgcttgtcttcctgccgcgggctggacgattttcgcatcggctggggaaccttggaatacgaaacccacgtcaccaacgatgaggacatgaggccgtactgctggcattaccctccgaggccttgcggcatcgtcccggctagaacggtttgcggaccggtctattgtttcacccctagccctgttgtcgtgggcaccactgacaagcagggcgtacccacctacacctggggggaaaacgagaccgatgtcttcctgctgaatagcacaagacccccgcgaggagcttggttcggctgcacttggatgaacgggactgggttcactaagacatgcggtgcaccaccttgccgcattaggaaagactacaacagcactatcgatttattgtgccccacagactgttttaggaagcaccccgatgctacctatcttaagtgtggagcagggccttggttaactcccaggtgcctggtagactacccttatagactgtggcattatccgtgcactgtaaacttcaccatctttaaggcgcggatgtatgtaggaggggtggagcatcgattctccgcagcatgcaacttcacgcgcggagatcgctgcagactggaagatagggataggggtcagcagagtccactgctgcattccactactgagtgggcggtgctcccatgctccttctctgacctaccagcactatccactggcctattgcacctccaccaaaacatcgtggacgtgcagtacctttacggactttctccggctctgacaagatacatcgtgaagtgggagtgggtgatcctccttttcttgttgttggcagacgccaggatctgtgcatgcctttggatgctcatcatactgggccaagccgaagcggcgcttgagaagctcatcatcttgcactccgctagtgctgctagtgccaatggtccgctgtggtttttcatcttctttacagcggcctggtacttaaagggcagggtggtccccgtggccacgtactctgttctcggcttatggtccttcctcctcctagtcctggccttaccacagcaggcttatgccttggacgctgctgaacaaggggaactggggctggccatattagtaattatatccatctttactcttaccccagcatacaagatcctcctgagccgttcagtgtggtggctgtcctacatgctggtcttggccgaggcccagattcagcaatgggttccccccctggaggtccgaggggggcgtgacggaatcatctgggtggctgtcattctacacccacgccttgtgtttgaggtcacgaaatggttgttagcaatcctggggcctgcctacctccttaaagcgtctctgctacggataccgtactttgtgagggcccacgctttgctacgagtgtgtaccctggtgaaacacctcgcgggggctaggtacatccagatgctgttgatcaccataggcagatggaccggcacttacatctacgaccacctctcccctttatcaacttgggcggcccagggtttgcgggacctggcaatcgccgtggagcctgtggtgttcagcccaatggagaagaaggtcattgtgtggggggctgagacagtggcgtgtggagacatcctgcatggcctcccggtctccgcgaggctaggtagggaggttctgctcggccctgccgacggctacacctccaaggggtggaagctcctagctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacctatgacgtggacatggtcgatgccaacctgctcatggagggcggtgtggctcagacagagcctgagtccagggtgcccgttctggactttctcgagccaatggccgaggaagagagcgaccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 49 - DNA, 9665 bp, Hepatitis C virus
gcctgcctcttacgaggcgacactccaccatggatcactcccctgtgaggaacttctgtcttcacgcggaaagcgcctagccatggcgttagtacgagtgtcgtgcagcctccaggaccccccctcccgggagagccatagtggtctgcggaaccggtgagtacaccggaatcgctggggtgaccgggtcctttcttggagcaacccgctcaatacccagaaatttgggcgtgcccccgcgagatcactagccgagtagtgttgggtcgcgaaaggccttgtggtactgcctgatagggtgcttgcgagtgccccgggaggtctcgtagaccgtgcaacatgagcacgaatcctaaacctcaaagaaaaaccaaacgtaacaccaaccgccgcccaatggacgttaagttcccgggtggtggccagatcgttggcggagtttacttgttgccgcgcaggggccccagattgggtgtgcgcgcgactcggaagacttcggagcggtcgcaacctcgtggaagacgccaacctatccccaaggcgcgtcgacccgagggaaggtcctgggcacaaccaggatatccatggcctctttacggtaatgagggttgtgggtgggcaggatggctcttgtccccccgtggctctcgaccgtcttggggcccaaatgatccccggcggaggtcccgcaatttgggtaaggtcatcgataccctaacctgcggcttcgccgacctcatgggatacatcccgctcgtaggcgcccccgtgggtggcgtcgccagggccctggcacatggtgtcagggctttggaggacgggatcaattatgcaacagggaatctccccggttgctccttttctatcttcctcttggcacttctttcgtgcctgactgtccccgcttcggccgttaactatcgcaatgtctcgggcatctaccatgtcaccaatgactgcccgaattcaagcatagtgtatgaggccgaccatcacatcttgcaccttccaggttgcgtgccctgcgtgagagaggggaatcagtcacgctgctgggtggcccttactcctaccgtcgcagcgccatacatcggcgcaccgcttgagtccttacggagtcatgtggatttgatggtgggggccgccactgtttgctcgggtctttacatcggggacctgtgtggcggcttgttcctagttggccagatgttttcattccgaccacggcgccactggaccacccaggattgcaattgttccatctacacagggcacattacaggccacagaatggcctgggacatgatgatgaactggagtccaacaaccaccttagttctcgcccaggtcatgaggatcccaaccactctggtagacttactctctggaggccactggggtgtcctcgtgggagtggcctatttcagcatgcaggccaattgggccaaagtcatcttggtcctattcctctttgcaggggttgatgccgagactcacgtgtctggggcagcagtcggccggagtaccgccggcttggctaacctcttttcttctgggtctaagcagaatttacagctcatcaacagcaatgggagctggcatataaataggactgcccttaactgcaatgacagcttaaacactgggttcttggctagcttgttctacacccacaagtttaacagctcagggtgttccgaacggctcgcgtgctgcaagagccttgacagctacggccaaggctggggcccactcggggtcgctaacatcagcggctcgtctgatgacaggccttattgctggcactacgcgcctcggccgtgcgggattgtgccagcatccagtgtgtgtggccccgtgtattgtttcactcccagccctgtcgtggtcggtactactgatcacgtcggggtccctacttacacctggggggagaatgagactgatgtcttccttttgaactcgaccagaccgccgcatggtgcgtggtttggatgcgtgtggatgaacagtaccgggttcaccaaaacctgtggcgcccctccatgcgaggttaacaccaataatgggacctggcactgccccaccgattgcttcaggaagcatccggagactacctacgccaagtgcggatcagggccttggatcacaccgcgctgcctgattgattacccgtaccggctgtggcatttcccgtgcaccgccaacttctccgtctttaacatcaggacatttgtcggcggtatagagcatcggatgcaagcggcatgcaactggaccaggggggaagtctgtggcttggagcacagggatcgcgtagagctatcacccctgctccttaccactacagcgtggcagatcctcccctgctctttcaccactttacctgccctctccaccggcttgatccacctccaccaaaatatcgtggacgtccagtacctctatggtgttgggtctgcagtggtatcttgggcccttaagtgggaatatgtggtgctcgcgttcctgcttctcgcggacgcgagagtctctgcctgcctatggatgatgtttatggtaagtcaagttgaggcggctctgtccaacctgattaacatcaatgctgcttcagccgctggtgcccaaggcttctggtacgccatcctcttcatctgcattgtctggcatgtcaagggccggttcccagctgctgctgcctacgcagcctgcgggctgtggcccctgtttctcctgcttctgatgctgcctgagagggcttatgcatacgaccaggaagtggcagggtcccttggcggcgccatcgttgtcatgctggccattctgacactgtctccgcactacaagttatggctggctaggggattgtggtggatccaatattttatagctaggaccgaggctgtgctgcatgtctatattccatccttcaacgtgcgcgggcctcgcgactcagtgattgttcttgcagtcctggtctgtccacacctagtatttgacatcacaaaatatcttctggccatcttagggcccctccacatactccaggcctcgctcctacgcatcccttactttgtgagggcacaagcgctggttaagatctgcagcttgttgcgtggggtagtttatggcaagtacttccaaatggtcgtgcttaaagcaggggccctgactggtacttacatctatgaccaccttactcccatgtcagattgggccgctacgggcctccgcgatttggcggtggccctagagccagttgtgttctcgcccatggagaagaaagtcatcgtctggggcgctgacaccgctgcgtgcggagacatcataaggggattacctgtttcggccaggttgggcaatgaaatcttgctcggaccagccgatacagaaacatcaaaggggtggagactccttgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacctatgacgtggacatggtcgatgccaacctgctcatggagggcggtgtggctcagacagagcctgagtccagggtgcccgttctggactttctcgagccaatggccgaggaagagagcgaccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 50 - DNA, 9668 bp, Hepatitis C virus
gcctgcctcttacgaggcgacactccaccatggatcactcccctgtgaggaacttctgtcttcacgcggaaagcgcctagccatggcgttagtacgagtgtcgtgcagcctccaggaccccccctcccgggagagccatagtggtctgcggaaccggtgagtacaccggaatcgctggggtgaccgggtcctttcttggagcaacccgctcaatacccagaaatttgggcgtgcccccgcgagatcactagccgagtagtgttgggtcgcgaaaggccttgtggtactgcctgatagggtgcttgcgagtgccccgggaggtctcgtagaccgtgcaacatgagcacgaatcctaaacctcaaagaaaaaccaaaagaaacaccaaccgccgcccacaggacgtcaagttcccgggcggtggtcagatcgttggtggagtttacttgttgccgcgcaggggccctaggttgggtgtgcgcgcaactcggaagacttcagaacggtcgcaaccccgtggacggcgtcagcctatccccaaggcgcgccagcccacgggccggtcctggggtcaacccgggtacccttggcccctttatgccaatgagggcctcgggtgggcagggtggttgctctccccccgaggctctcggcctaattggggccccaatgacccccggcggaaatcgcgcaacttgggtaaggtcatcgataccctgacgtgcggattcgccgacctcatggggtacatcccgctcgtaggcggccccgttgggggcgtcgcaagggctctcgcacacggtgtgagggtccttgaggacggggtaaactatgcaacagggaatttacccggttgctctttctctatctttatccttgcacttctttcatgcctgactgtcccgacctctgccgttccctaccgaaatgcctctggggtttatcatgtcaccaatgattgcccaaactcttctatcgtctatgaggctgaagacctgatcttacacgcacctggttgcgtgccctgtgttaggcagggtaatgtcagtaggtgctgggtccagatcacccccacactgtcagccccgagcctcggagcggtcacggctcctcttcggagggccgttgactacttagcggggggggctgccctttgctccgcgttatacgtcggagacgcgtgcggggcagtgtttttggtaggtcaaatgttcacctatagccctcgccggcataatgttgtgcaggactgcaactgttccatttacagtggccacatcaccggccaccggatggcatgggacatgatgatgaattggtcacctacaacagctttggtgatggcccagttgttacggattccccaggtggtcattgacatcattgccggggcccactggggggtcttgttcgccgccgcatactacgcgtcggcggctaactgggccaaggttgtgctggtcctgtttctgtttgcgggggtcgatgccagcacccgcactgtgggtggtagtgcggcccaaggcgcgcgcgggctcgcttcacttttcacccctgggccgcagcagaacttgcagctcataaataccaacgggagctggcacatcaacagaactgcccttaactgtaatgacagcctccagactgggtttgtagccggcctcctgtattatcacaagttcaactccactgggtgtccgcagcggatggctagctgtaggcccctcgccgcattcgaccagggctggggaactatcagctatgccgccgtgtcgggccccagtgatgacaagccctattgctggcactaccccccacgcccgtgcggaatagtgccagcgcgaggtgtctgcggtccggtctattgttttacacctagcccggtggtcgtcggcaccacagaccgcaaggggaatcccacttacagttggggcgaaaatgagactgacatctttctcttgaacaacacgaggccccctactggcaactggtttggctgcacctggatgaattccacagggtttgtcaagacttgcggggctccaccctgcaacttagggcctacaggcaacaatagccttaagtgtcctactgattgcttccgcaagcacccagacgccacctacaccaagtgtgggtcaggaccctggctcactccccggtgtctggtgcattacccttaccggttgtggcattacccgtgcaccctaaattacaccatcttcaaggtgcgcatgtacattgggggcctcgagcacaggctcgaggtggcatgcaactggacccgtggtgagcggtgtgatcttgaagacagggatagggccgagctgagcccgctcctacataccaccacgcagtgggccatattgccgtgctctttcacacccacacccgctcttagcactggtctcatacacttacatcaaaatatagtagacacccagtatctttacggtctgagctccagcatcgtctcgtgggccgttaagtgggagtacatagtgctggccttcttattacttgctgatgcccgtatttgtacttgcctatggatcatgctcctggtttgtcaggccgaagcggccctggagaacgtcattgtcctaaacgcggctgcggctgcggggactcatgggtttttctggggcctgctcgtcatctgcttcgcctggcacttcaagggcaggttggtccctggggccacctacctttgcttgggcatttggccattactcttactccttttcctcctgccccaaagggctctagccctggactcaagcgatggcgggactgtgggttgtcttgtgttaaccatccttacaatcttcacactcacccccgggtacaagaagatggtagtgttggtcatatggtggcttcagtatttcatagcccgggtagaggcctttatccatgtgtgggtgcccccgttgcaggttaggggtggtcgtgatgctattatcatgctcacatgccttttccatcctgccctggggtttgaggtcacgaaaatcctcctcgggatactaggtcctttgtacctgctgcagtactcgctcatcaagctgccttatttcatcagggcgcgcgccctgctgagggcgtgcctgctagcgaagcacttggcctgtggcaggtacgtgcaggcggccttgctccaccttggtaggctgaccggaacgtacatttatgaccaccttgcccccatgaaggattgggcagcgtccgggctgcgcgacttagcagtggccacggagcccatcatattctcccctatggagacgaaggtcatcacgtggggggctgacacggccgcatgtggggacatacttgccggccttcctgtatcagctaggcgaggccatgaaatcttcctggggccagccgatgacatcagagaggggggctggcgacttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaggtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacctatgacgtggacatggtcgatgccaacctgctcatggagggcggtgtggctcagacagagcctgagtccagggtgcccgttctggactttctcgagccaatggccgaggaagagagcgaccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 51 - DNA, 9683 bp, Hepatitis C virus
gcctgcctcttacgaggcgacactccaccatggatcactcccctgtgaggaacttctgtcttcacgcggaaagcgcctagccatggcgttagtacgagtgtcgtgcagcctccaggaccccccctcccgggagagccatagtggtctgcggaaccggtgagtacaccggaatcgctggggtgaccgggtcctttcttggagcaacccgctcaatacccagaaatttgggcgtgcccccgcgagatcactagccgagtagtgttgggtcgcgaaaggccttgtggtactgcctgatagggtgcttgcgagtgccccgggaggtctcgtagaccgtgcaacatgagcacacttccaaaaccccaaagaaaaaccaaaagaaacaccaaccgtcgcccaatggacgtcaagttcccgggtggcggtcagatcgttggcggagtttacttgttgccgcgcaggggcccccggttgggtgtgcgcgcgacgaggaagacttccgagcgatcccagcccagaggcaggcgccaacctataccaaaggcgcgccagccccagggcaggcactgggctcagcccggatatccttggcccctttatgggaacgagggctgtgggtgggcaggttggctcctgtccccccgcggctcccggccacactggggccccaacgacccccggcgtcgatcccggaatttgggtaaggtcatcgataccctaacgtgtgggttcgccgatctcatggggtacattcccgtcgtgggcgcgcctttgggcggcgtcgcggctgcactcgcacatggtgtgagggcaatcgaggacgggatcaattatgcaacagggaatcttcccggttgctctttctctatcttcctcttggcactactctcgtgcctcacaacgccagcgtcggctcttacctacggtaactccagtgggctataccatcttacaaatgattgccccaactccagcatcgtgctggaggcggatgccatgatcttgcatttgcctggatgcttgccttgtgtgagggtcaataacaaccagtccatctgttggcatgctgtgtcccccaccctagccataccaaatgcttccacacctgcaacgggattccgtaggcatgtggaccttcttgcgggcgccgcagtggtttgctcatccctgtacatcggggatctgtgcggctccctctttttggcagggcaactatttacctttcagccccgccgtcactggactgtgcaagactgcaactgctccatttatacaggccacgtcaccggccacaggatggcttgggacatgatgatgaattggtcacccacaaccactctggtcctatctagtatcttgagggtacctgagatctgtgcgagtgtgatatctggtggccattgggggatactactagccgttgcctactttggtatggctggcaactggctaaaagttctggctgtcctgttcttatttgcaggggttgaagcaaccaccaccatcggccatcaagtaggccgcactactggtggcttagccagtctcttctccatcggtcccaggcaaaatctacaactcatcaacaccactggcagctggcatataaacaggactgctctgaactgcaatgattccctccagacggggttcataacgtcactcttttatgccaagaacgtcaactcctcgggctgcccagagcggatggctgcgtgtaagcccctcgcggacttccggcaggggtggggccaaataacctacaaagtcaacatctcgggcccctccgacgaccgtccctactgttggcattacgctcccaggccatgtgacgtggtgtcggcccgcacggtgtgcggccccgtttactgcttcacgcccagccctgtcgtagtaggaaccactgacaagctgggcattcccacatacaactggggggagaatgagacggatgtgttcatgttggaaagccttcggcctcctactggaggatggtttgggtgcacgtggatgaactctacgggctttaccaagacctgtggtgccccgccatgtcagatagtcccgggagattacaatagctctgccaatgagcttttgtgccccaccgactgcttccgtaaacatccggaagctacatatcagcggtgtggatcgggaccctggatcacacctaggtgtctggtggattacccctacaggctgtggcactacccctgtactgtcaacttcaccttgcataaagtcaggatgttcgtgggaggcattgagcatcggtttgacgccgcatgtaactggaccagaggcgagcggtgtgatctacatgacagagacaggattgaaatgagcccgctgcttttctcaactacgcagcttgccatacttccctgttcattttccaccatgccggccttgtcaaccggcctcatccacctgcatcagaacatagtggacgtgcagtacctctacggagtctcctcgagcgttacctcgtgggtggtgaagtgggagtacattgttctggtgttcctggttctggcagatgctcggatttgtacatgtctctggttaatgctgctcataaccaacgttgaagcagcagtggaaaggcttgtcgtcctcaatgcggctagcgccgccggcaccgccggctggtggtgggcggtgctcttcctgtgctgtgcttggtacgtgaaaggccgccttgtgcctgcgtgtacctacatggcactgggaatgtggccgttgctcctgacaatcttggccctgcctcgccgagcatacgctatggacaatgagcaagcggcatccctcggagctgttggtctcttggtgctcaccatctttaccatcacccccatgtacaagaagctgttgacctgctccatttggtggaatcagtatttcctcgcccgagctgaggccatgatacacgagtgggtgcccgacctacgggttaggggcggtagggactccatcatcttacttacctgcttgttacatccacagctggggtttgaggtcaccaaaattctactagccatcctggcccctctatacatcctgcagtacagtttgctcaaggtgccttactttgtgcgcgcccacgtactcctgcgtgcttgcctgcttgttcgtaggctagcagggggtaagtacgtgcaggcgtgccttctgaggttgggcgcttggactggcacctttgtctatgaccatctcgcccctctctctgactgggctagcgacggactgcgcgatttggcagtcgcaatcgagccggtcattttctctcccatggagaagaaaatcattacctggggtgcggataccgccgcgtgtggtgacatcttgagtggcctcccggtgtcagcgaggttggggaatttggtgctactgggacccgcggacgatatgcagcgcgggggttggaagcttttggctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacctatgacgtggacatggtcgatgccaacctgctcatggagggcggtgtggctcagacagagcctgagtccagggtgcccgttctggactttctcgagccaatggccgaggaagagagcgaccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 52 - DNA, 9677 bp, Hepatitis C virus
gcctgcctcttacgaggcgacactccaccatggatcactcccctgtgaggaacttctgtcttcacgcggaaagcgcctagccatggcgttagtacgagtgtcgtgcagcctccaggaccccccctcccgggagagccatagtggtctgcggaaccggtgagtacaccggaatcgctggggtgaccgggtcctttcttggagcaacccgctcaatacccagaaatttgggcgtgcccccgcgagatcactagccgagtagtgttgggtcgcgaaaggccttgtggtactgcctgatagggtgcttgcgagtgccccgggaggtctcgtagaccgtgcaacatgagcacgaatcctaaacctcaaagattaaccaaaagaaacaccgtccgtcgcccacagaacgttaagttcccgggtggcgggcagatcgttggcggagtctacttgttgccgcgcaggggccctagattgggtgtgcgcggcactaggaagagttcggagcgatcgcagcccaggggaagacgccaacgtatccccaaagctgcctcttcacagggtaaagcctggggcaagcccgggtacccttggcccctgtatggtaacgagggctgtggctgggcagggtggctcctgtccccccgcggctctcgacctacttggggccccactgacccccggcaccgctcgcgaaacctcggtaaggtgatcgacaccatgacctgcgggtttgccgacctcatggggtacatccctgtcctaggcgcccccctagggggcgttgccagggctctggcacatggtgttagagttctggaggacggggtcaactatgcaacagggaacttgcctggttgctccttttctatcttcttactagccctcctgtcatgtctaacagtcccggcatcggcttatgaagtccgcaactccagtggggtctatcatctcaccaatgactgccccaacgctagtatagtctatgaaacagacaacgccatcctacacgagcctgggtgcgtgccttgcgttcgcgagggtaatactagcaggtgttgggaaccagtggcccccactttggcggtccgctatcgcggagcgcttactgacgatttgcggacgcatattgacctagtggtggcgtcagctaccctgtgctccgccttgtacgtgggggacatttgtggagccatcttcattgccagccaagctgttctctggaagcccggggggggtcggatagtgcaagattgcaattgttcgatctacccgggccacgtcaccggccacaggatggcgtgggacatgatgcagaactgggcgccggccttgtcaatggttgccgcttacgctgtgagagtgcccggtgtcatcattaccactgtagcgggcggccactggggtgtgttatttggcctcgcttactttggtatggcgggaaactgggcaaaggtaatactcatcatgctactcatgtccggcgtcgacgcggaaaccatggccgtcggggctagggccgctcacaccactggcgcccttgtcagcctgctcaatccagggcccagtcagcgcctgcagctgatcaacaccaatgggtcatggcacatcaaccggaccgctttgaactgcaatgactctttgcagacagggttcatagcggccctcttctacacacataggttcaattctagtggctgtcccgagaggatggcttcttgtaaacctctcagtgactttgaccaggggtggggcccgctgtggtacaattcaacagaaagaccttcggaccagcgaccctattgctggcactacgcgccatcgccgtgtggtattgtgccggctaaggatgtttgcggtccggtctactgctttacaccaagcccggttgtggtgggcaccacggatcgccggggggtgcccacgtatacttggggtgaaaatgagtctgatgtcttcctgctcaacagcacaaggccgccgcaaggcagttggtttgggtgctcatggatgaacacaacggggttcacgaagacctgcggaggtcctccgtgcaagatacgtccccagggtgcccagagtaacacctctctcacttgtcccacagactgcttcaggaaacatccgcgtgccacatactccgcttgcggatctggtccgtggttgacacctagatgcatggtccattacccctatagactgtggcactacccgtgtacagtcaacttcaccatacacaaagtcaggttatacatagggggtgtagaacataggctcgatgcagcgtgcaattggacgcggggtgagcgatgcgacctggaggaccgagacagggtggacatgtcccccctgctccattccactacggagctcgcaatacttccgtgttcctttgtgccgcttccggccttatctacgggactgatccacctgcaccaaaacatcgttgacgcccagtacctttatggtctttctcccgctataataagctgggccatcagatgggagtgggtagtcctcgttttcctactcctggcggacgcgcggatctgcgcctgcctttggatgatgatgcttatggcccaggctgaagccgctctggagaacttgatccacctcaacgcggccagccttgcgggaacccatggtatctggtggctccttttagtcttttgtgcctcttggcatctacgaggcagggttgtccctctggtgacgtatgggatatgcgggatgtggcccttcttcctcatgttgctgagcctccccccacgagcgtatgctctggacagggaagtgagcgcagcgttgggaacgggcatgctcgccatcatcctattagttaccttgggaccgcactacaagagacttctagcccttattctctggtgggtcacatatttccttacaaggtgtgaagcagcactccaaacgtgggtccctcctctcaaccctcgggggggcagggacggtttcatcctgtgtgtgctgctgtgctatccaggccttgtctttgacatcacaaaatggttgctggtcatgatgtgccctctctacctcctccagttgtgtttggtgaggactccatactttgtgagggcccaggccctcatcagagtgtgttctctcttcaaaacgctagctgggggacggtacgtgcaggccgcgctgctcactattggccgctggaccggcacttatatttataaccatctcgcccccctggaaacatgggccgccggcggcctacgggatttggccgttgcagtcgagcccgtgatattctcccccatggagaagaagatcatagtttggggggcggagaccactgcttgtggcgacattctttgtggcctgcctgtctcagctcggctcggcagggaagtcctgctagggcccgcggatgactacaggtccatgggatggcaactcctggctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacctatgacgtggacatggtcgatgccaacctgctcatggagggcggtgtggctcagacagagcctgagtccagggtgcccgttctggactttctcgagccaatggccgaggaagagagcgaccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 53 - protein, 3029 aa, Hepatitis C virus; identical to SEQ ID NO: 30

SEQ ID NO: 54 - protein, 3033 aa, Hepatitis C virus; identical to SEQ ID NO: 31

SEQ ID NO: 55 - protein, 3033 aa, Hepatitis C virus; identical to SEQ ID NO: 32

SEQ ID NO: 56 - protein, 3035 aa, Hepatitis C virus; identical to SEQ ID NO: 33

SEQ ID NO: 57 - protein, 3029 aa, Hepatitis C virus; identical to SEQ ID NO: 34

SEQ ID NO: 58 - protein, 3030 aa, Hepatitis C virus; identical to SEQ ID NO: 35

SEQ ID NO: 59 - protein, 3035 aa, Hepatitis C virus; identical to SEQ ID NO: 36

SEQ ID NO: 60 - protein, 3033 aa, Hepatitis C virus
MSTNPKPQRLTKRNTVRRPQNVKFPGGGQIVGGVYLLPRRGPRLGVRGTRKSSERSQPRGRRQRIPKAASSQGKAWGKPGYPWPLYGNEGCGWAGWLLSPRGSRPTWGPTDPRHRSRNLGKVIDTMTCGFADLMGYIPVLGAPLGGVARALAHGVRVLEDGVNYATGNLPGCSFSIFLLALLSCLTVPASAYEVRNSSGVYHLTNDCPNASIVYETDNAILHEPGCVPCVREGNTSRCWEPVAPTLAVRYRGALTDDLRTHIDLVVASATLCSALYVGDICGAIFIASQAVLWKPGGGRIVQDCNCSIYPGHVTGHRMAWDMMQNWAPALSMVAAYAVRVPGVIITTVAGGHWGVLFGLAYFGMAGNWAKVILIMLLMSGVDAETMAVGARAAHTTGALVSLLNPGPSQRLQLINTNGSWHINRTALNCNDSLQTGFIAALFYTHRFNSSGCPERMASCKPLSDFDQGWGPLWYNSTERPSDQRPYCWHYAPSPCGIVPAKDVCGPVYCFTPSPVVVGTTDRRGVPTYTWGENESDVFLLNSTRPPQGSWFGCSWMNTTGFTKTCGGPPCKIRPQGAQSNTSLTCPTDCFRKHPRATYSACGSGPWLTPRCMVHYPYRLWHYPCTVNFTIHKVRLYIGGVEHRLDAACNWTRGERCDLEDRDRVDMSPLLHSTTELAILPCSFVPLPALSTGLIHLHQNIVDAQYLYGLSPAIISWAIRWEWVVLVFLLLADARICACLWMMMLMAQAEAALENLIHLNAASLAGTHGIWWLLLVFCASWHLRGRVVPLVTYGICGMWPFFLMLLSLPPRAYALDREVSAALGTGMLAIILLVTLGPHYKRLLALILWWVTYFLTRCEAALQTWVPPLNPRGGRDGFILCVLLCYPGLVFDITKWLLVMMCPLYLLQLCLVRTPYFVRAQALIRVCSLFKTLAGGRYVQAALLTIGRWTGTYIYNHLAPLETWAAGGLRDLAVAVEPVIFSPMEKKIIVWGAETTACGDILCGLPVSARLGREVLLGPADDYRSMGWQLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTYDVDMVDANLLMEGGVAQTEPESRVPVLDFLEPMAEEESDLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 61 - protein, 3029 aa, Hepatitis C virus; identical to SEQ ID NO: 29

SEQ ID NO: 62 - protein, 3029 aa, Hepatitis C virus; identical to SEQ ID NO: 30

SEQ ID NO: 63 - protein, 3033 aa, Hepatitis C virus; identical to SEQ ID NO: 31

SEQ ID NO: 64 - protein, 3033 aa, Hepatitis C virus; identical to SEQ ID NO: 32

SEQ ID NO: 65 - protein, 3029 aa, Hepatitis C virus; identical to SEQ ID NO: 34

SEQ ID NO: 66 - protein, 3030 aa, Hepatitis C virus
MSTNPKPQRKTKRNTNRRPQDVKFPGGGQIVGGVYLLPRRGPRLGVRATRKTSERSQPRGRRQPIPKARQPTGRSWGQPGYPWPLYANEGLGWAGWLLSPRGSRPNWGPNDPRRKSRNLGKVIDTLTCGFADLMGYIPLVGGPVGGVARALAHGVRVLEDGVNYATGNLPGCSFSIFILALLSCLTVPTSAVPYRNASGVYHVTNDCPNSSIVYEAEDLILHAPGCVPCVRQGNVSRCWVQITPTLSAPSLGAVTAPLRRAVDYLAGGAALCSALYVGDACGAVFLVGQMFTYSPRRHNVVQDCNCSIYSGHITGHRMAWDMMMNWSPTTALVMAQLLRIPQVVIDIIAGAHWGVLFAAAYYASAANWAKVVLVLFLFAGVDASTRTVGGSAAQGARGLASLFTPGPQQNLQLINTNGSWHINRTALNCNDSLQTGFVAGLLYYHKFNSTGCPQRMASCRPLAAFDQGWGTISYAAVSGPSDDKPYCWHYPPRPCGIVPARGVCGPVYCFTPSPVVVGTTDRKGNPTYSWGENETDIFLLNNTRPPTGNWFGCTWMNSTGFVKTCGAPPCNLGPTGNNSLKCPTDCFRKHPDATYTKCGSGPWLTPRCLVHYPYRLWHYPCTLNYTIFKVRMYIGGLEHRLEVACNWTRGERCDLEDRDRAELSPLLHTTTQWAILPCSFTPTPALSTGLIHLHQNIVDTQYLYGLSSSIVSWAVKWEYIVLAFLLLADARICTCLWIMLLVCQAEAALENVIVLNAAAAAGTHGFFWGLLVICFAWHFKGRLVPGATYLCLGIWPLLLLLFLLPQRALALDSSDGGTVGCLVLTILTIFTLTPGYKKMVVLVIWWLQYFIARVEAFIHVWVPPLQVRGGRDAIIMLTCLFHPALGFEVTKILLGILGPLYLLQYSLIKLPYFIRARALLRACLLAKHLACGRYVQAALLHLGRLTGTYIYDHLAPMKDWAASGLRDLAVATEPIIFSPMETKVITWGADTAACGDILAGLPVSARRGHEIFLGPADDIREAGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTRSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTYDVDMVDANLLMEGGVAQTEPESRVPVLDFLEPMAEEESDLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 67 - protein, 3035 aa, Hepatitis C virus; identical to SEQ ID NO: 36

SEQ ID NO: 68 - protein, 3033 aa, Hepatitis C virus; identical to SEQ ID NO: 60

SEQ ID NO: 69 - DNA, 10263 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacgaatcctaaacctcaaagaaaaaccaaacgtaacaccaaccgtcgcccacaggacgtcaagttcccgggtggcggtcagatcgttggtggagtttacttgttgccgcgcaggggccctagattgggtgtgcgcgcgacgaggaagacttccgagcggtcgcaacctcgaggtagacgtcagcctatccccaaggcacgtcggcccgagggcaggacctgggctcagcccgggtacccttggcccctctatggcaatgagggttgcgggtgggcgggatggctcctgtctccccgtggctctcggcctagctggggccccacagacccccggcgtaggtcgcgcaatttgggtaaggtcatcgatacccttacgtgcggcttcgccgacctcatggggtacataccgctcgtcggcgcccctcttggaggcgctgccagggccctggcgcatggcgtccgggttctggaagacggcgtgaactatgcaacagggaaccttcctggttgctctttctctatcttccttctggccctgctctcttgcctgactgtgcccgcttcagcctaccaagtgcgcaattcctcggggctttaccatgtcaccaatgattgccctaactcgagtattgtgtacgaggcggccgatgccatcctgcacactccggggtgtgtcccttgcgttcgcgagggtaacgcctcgaggtgttgggtggcggtgacccccacggtggccaccagggacggcaaactccccacaacgcagcttcgacgtcatatcgatctgcttgtcgggagcgccaccctctgctcggccctctacgtgggggacctgtgcgggtctgtctttcttgttggtcaactgtttaccttctctcccaggcgccactggacgacgcaagactgcaattgttctatctatcccggccatataacgggtcatcgcatggcatgggatatgatgatgaactggtcccctacggcagcgttggtggtagctcagctgctccggatcccacaagccatcatggacatgatcgctggtgctcactggggagtcctggcgggcatagcgtatttctccatggtggggaactgggcgaaggtcctggtagtgctgctgctatttgccggcgtcgacgcggaaacccacgtcaccgggggaaatgccggccgcaccacggctgggcttgttggtctccttacaccaggcgccaagcagaacatccaactgatcaacaccaacggcagttggcacatcaatagcacggccttgaattgcaatgaaagccttaacaccggctggttagcagggctcttctatcaacacaaattcaactcttcaggctgtcctgagaggttggccagctgccgacgccttaccgattttgcccagggctggggtcctatcagttatgccaacggaagcggcctcgacgaacgcccctactgctggcactaccctccaagaccttgtggcattgtgcccgcaaagagcgtgtgtggcccggtatattgcttcactcccagccccgtggtggtgggaacgaccgacaggtcgggcgcgcctacctacagctggggtgcaaatgatacggatgtcttcgtccttaacaacaccaggccaccgctgggcaattggttcggttgtacctggatgaactcaactggattcaccaaagtgtgcggagcgcccccttgtgtcatcggaggggtgggcaacaacaccttgctctgccccactgattgcttccgcaaacatccggaagccacatactctcggtgcggctccggtccctggattacacccaggtgcatggtcgactacccgtataggctttggcactatccttgtaccatcaattacaccatattcaaagtcaggatgtacgtgggaggggtcgagcacaggctggaagcggcctgcaactggacgcggggcgaacgctgtgatctggaagacagggacaggtccgagctcagcccgttgctgctgtccaccacacagtggcaggtccttccgtgttctttcacgaccctgccagccttgtccaccggcctcatccacctccaccagaacattgtggacgtgcagtacttgtacggggtagggtcaagcatcgcgtcctgggccattaagtgggagtacgtcgttctcctgttccttctgcttgcagacgcgcgcgtctgctcctgcttgtggatgatgttactcatatcccaagcggaggcggctttggagaacctcgtaatactcaatgcagcatccctggccgggacgcacggtcttgtgtccttcctcgtgttcttctgctttgcgtggtatctgaagggtaggtgggtgcccggagcggcctacgccctctacgggatgtggcctctcctcctgctcctgctggcgttgcctcagcgggcatacgcactggacacggaggtggccgcgtcgtgtggcggcgttgttcttgtcgggttaatggcgctgactctgtcgccatattacaagcgctatatcagctggtgcatgtggtggcttcagtattttctgaccagagtagaagcgcaactgcacgtgtgggttccccccctcaacgtccggggggggcgcgatgccgtcatcttactcatgtgtgtagtacacccgaccctggtatttgacatcaccaaactactcctggccatcttcggacccctttggattcttcaagccagtttgcttaaagtcccctacttcgtgcgcgttcaaggccttctccggatctgcgcgctagcgcggaagatagccggaggtcattacgtgcaaatggccatcatcaagttaggggcgcttactggcacctatgtgtataaccatctcacccctcttcgagactgggcgcacaacggcctgcgagatctggccgtggctgtggaaccagtcgtcttctcccgaatggagaccaagctcatcacgtggggggcagataccgccgcgtgcggtgacatcatcaacggcttgcccgtctctgcccgtaggggccaggagatactgcttgggccagccgacggaatggtctccaaggggtggaggttgctggctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgccctggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 70 - DNA, 10263 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacgaatcctaaacctcaaagaaaaaccaaacgtaacaccaaccgtcgcccacaggacgtcaagttcccgggtggcggtcagatcgttggtggagtttacttgttgccgcgcaggggccctagattgggtgtgcgcgcgacgaggaagacttccgagcggtcgcaacctcgaggtagacgtcagcctatccccaaggcgcgtcggcccgagggcaggacctgggctcagcccgggtacccttggcccctctatggcaatgagggttgcgggtgggcgggatggctcctgtctccccgtggctctcggcctagctggggccccacggacccccggcgtaggtcgcgcaatttgggtaaggtcatcgatacccttacgtgcggcttcgccgacctcatggggtacataccgctcgtcggcgcccctcttggaggcgctgccagggccctggcgcatggcgtccgggttttggaagacggcgtgaactatgcaacagggaaccttcctggttgctctttctctattttccttctggccctgctctcttgtctgactggacccgcttcagcctaccaagtgcgcaactccacggggctttaccatgtcaccaatgattgccccaactcgagcattgtgttcgaggcggctgatgccatcctgcacactccggggtgtgtcccttgcgtacgcgagggtaacgcctcgaggtgttgggtggcggtaacccccacggtggccaccagggatggcaaactccccacaacgcagcttcgacgtcacatcgatctgcttgtcgggagcgccaccctctgctcggccctttacgtgggggacctgtgcgggtctgtctttcttgttggtcaactgttcaccttctctcccaggcgccactggacgacgcaagattgcaattgttctatctaccccggccatatttcaggtcaccgtatggcatgggatatgatgatgaactggtcccctacggcggcgttgttggtagctcagctgctccggatcccacaagccatcctggacatgatcgctggtgctcactggggagtcctggcgggcatggcgtatttctccatggtggggaactgggcgaaggttctggtagtgctgctgctatttgccggcgtcgacgcggaaacctacgtcaccgggggaagtgccgcccgtactacggctggacttgctagtcttttctcaccaggcgccaagcagaacatccagctggtcaacaccaacggcagttggcacatcaatagcacggccttgaactgcaatgacagcctcaacaccggctggatagcaggacttttctatcaccacaaattcaactcttcgggctgttccgagaggttagccagctgccgaccccttaccgattttgcccagggctggggccctatcagtcacgccgacggaagtggccccgaccaacgcccctactgctggcactaccctccaaaaccttgtggtattgtgcccgcaaagagcgtgtgtggcccggtatattgtttcactcccagtcccgtggtggtgggaacgaccgacaggtcgggcgcgcctacctacagctggggtgcaaatgacacggacgtcttcgtccttaacaacaccaggccaccgctgggcaattggttcggttgcacctggatgaactcaactggattcaccaaagtgtgcggagcgcccccttgcgtcatcggaggggtgggcaacaacaccttgcgctgccccactgattgtttccgcaagcatccggaagccacatactctcggtgcggctccggtccctggattacgcccaggtgcctggtcgactacccgtataggctttggcattatccttgtaccatcaactacaccgtgtttaaagtcaggatgtacgtgggaggggtcgagcacaggctggaagctgcctgcaactggacgcggggcgaccgttgtaatctggatgacagggacaggtccgagctcagcccgctgctgctgtccactacgcagtggcaggtcctcccgtgttccttcacgaccctgccagccttgtccaccggcctcatccacctccaccaaaacatcgtggacgtgcaatacttgtacggggtgggatcaagcatcgcgtcctgggccatcaagtgggaatacgtcgttctcttgttccttctgcttgcagacgcgcgcgtctgctcctgcttgtggatgatgttactcatatcccaagtggaggcggctttggagaacctcgtagtactcaatgcagcatccctggccgggacacacggtcttgtatccttcctcgtgttcttctgctttgcatggtatctgaagggtaagtgggtgcccggagcggcctacgccctctacgggatgtggcctctcctcttgctcctgttagcgttgccccagcgggcatacgcactggacacggaggtggccgcgtcgtgtggcggcgttgttcttgtcgggttaatggcgctgactctgtcaccatattacaagcgctatatcagctggtgcttgtggtggcttcagtatttcctgaccagaatagaagcgcaactgcacgtgtggattccccctctcaacgtccggggggggcgcgatgccgtcatcttactcatgtgtgttgtgcacccggctctggtatttgacatcaccaagctactgctggctgccttcgggcccctttggattcttcaagccagtttgcttaaggtaccctacttcgtgcgcgttcaaggccttctccggatctgcgcgctagcgcggaagatggctggaggccattacgtgcaaatggccatcatcaagttaggggcgcttactggcacttatgtttacaaccatctcaccccccttcgggactgggcgcacaacggcctgcgagatctggccgtggctgtggagccagtcgtcttctcccgaatggagaccaagcttatcacctggggggcagacaccgccgcgtgcggtgacatcatcaacggcttgcccgtctccgcccggaggggccgggagatactgctcgggccagccgatggaatggtctccaaggggtggagattgctggctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgccctggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 71 - DNA, 10263 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacgaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaaggcttccgagcggtcgcaacctcgtggaaggcgacaacctatcccaaaggctcgccgacccgagggcagggcctgggctcagcccgggtacccttggcccctctatggcaatgagggcctggggtgggcaggatggctcctgtcaccccgcggctcccggcctagttggggccccacggacccccggcgtaggtcgcgtaacttgggtaaggtcatcgatacccttacatgcggcttcgccgatctcatggggtacattccgctcgtcggcgcccccctagggggcgctgccagggccttggcacacggtgtccgggttctggaggacggcgtgaactatgcaacagggaacttgcccggttgctctttctctatcttcctcttggctctgctgtcctgtttgaccatcccagcttccgcttatgaagtgcgcaacgtgtccgggatataccatgtcacgaacgactgctccaactcaagcattgtgtatgaggcagcggacgtgatcatgcatactcccgggtgcgtgccctgtgttcaggagggtaacagctcccgttgctgggtagcgctcactcccacgctcgcggccaggaatgccagcgtccccactacgacaatacgacgccacgtcgacttgctcgttgggacggctgctttctgctccgctatgtacgtgggggatctctgcggatctattttcctcgtctcccagctgttcaccttctcgcctcgccggcatgagacagtgcaggactgcaactgctcaatctatcccggccatgtatcaggtcaccgcatggcttgggatatgatgatgaactggtcacctacaacagccctagtggtgtcgcagttgctccggatcccacaagctgtcgtggacatggtggcgggggcccactggggagtcctggcgggccttgcctactattccatggtagggaactgggctaaggttctgattgtggcgctactctttgccggcgttgacggggagacccacacgacggggagggtggccggccacaccacctccgggttcacgtcccttttctcatctggggcgtctcagaaaatccagcttgtgaataccaacggcagctggcacatcaacaggactgccctaaattgcaatgactccctccaaactgggttctttgccgcgctgttttacgcacacaagttcaactcgtccgggtgcccggagcgcatggccagctgccgccccattgactggttcgcccaggggtggggccccatcacctatactaagcctaacagctcggatcagaggccttattgctggcattacgcgcctcgaccgtgtggtgtcgtacccgcgtcgcaggtgtgtggtccagtgtattgtttcaccccaagccctgttgtggtggggaccaccgatcgttccggtgtccctacgtatagctggggggagaatgagacagacgtgatgctcctcaacaacacgcgtccgccacaaggcaactggttcggctgtacatggatgaatagtactgggttcactaagacgtgcggaggtcccccgtgtaacatcgggggggtcggtaaccgcaccttgatctgccccacggactgcttccggaagcaccccgaggctacttacacaaaatgtggctcggggccctggttgacacctaggtgcctagtagactacccatacaggctttggcactacccctgcactctcaatttttccatctttaaggttaggatgtatgtggggggcgtggagcacaggctcaatgccgcatgcaattggactcgaggagagcgctgtaacttggaggacagggataggtcagaactcagcccgctgctgctgtctacaacagagtggcagatactgccctgtgctttcaccaccctaccggctttatccactggtttgatccatctccatcagaacatcgtggacgtgcaatacctgtacggtgtagggtcagcgtttgtctcctttgcaatcaaatgggagtacatcctgttgcttttccttctcctggcagacgcgcgcgtgtgtgcctgcttgtggatgatgctgctgatagcccaggctgaggccgccttagagaacttggtggtcctcaatgcggcgtccgtggccggagcgcatggtattctctcctttcttgtgttcttctgcgccgcctggtacattaagggcaggctggctcctggggcggcgtatgctttttatggcgtatggccgctgctcctgctcctactggcgttaccaccacgagcttacgccttggaccgggagatggctgcatcgtgcgggggtgcggttcttgtaggtctggtattcttgaccttgtcaccatactacaaagtgtttctcactaggctcatatggtggttacaatactttatcaccagagccgaggcgcacatgcaagtgtgggtcccccccctcaacgttcggggaggccgcgatgccatcatcctcctcacgtgtgcggttcatccagagttaattcttgacatcaccaaactcctgctcgccatactcggcccgctcatggtgctccaggctggcataacgagagtgccgtacttcgtgcgcgctcaagggctcattcgtgcatgcatgttagtgcgaaaagtcgccgggggtcattatgtccaaatggtcttcatgaagctgggcgcgctgacaggtacgtacgtttataaccatcttaccccactgcgggactgggcccacgcgggcctacgagaccttgcggtggcggtagagcccgtcgtcttctccgccatggagaccaaggtcatcacctggggagcagacaccgctgcgtgtggggacatcatcttgggtctacccgtctccgcccgaagggggaaggagatatttttgggaccggctgatagtctcgaagggcaagggtggcgactccttgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagactgggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 72 - DNA, 10281 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacacttcctaaacctcaaagaaaaaccaaaagaaacaccatccgtcgcccacaggacgttaagttcccgggtggcggacagatcgttggtggagtatacgtgttgccgcgcaggggcccacgattgggtgtgcgcgcgacgcgtaaaacttctgaacggtcacagcctcgcggacgacgacagcctatccccaaggcgcgtcggagcgaaggccggtcctgggctcagcccgggtacccttggcccctctatggtaatgagggctgcgggtgggcagggtggctcctgtccccgcgcggctcccgtccatcttggggcccaaacgacccccggcggaggtcccgcaatttgggtaaagtcatcgatacccttacgtgcggattcgccgacctcatggggtacatcccgctcgtcggcgctcccgtaggaggcgtcgcaagagccctcgcgcatggcgtgagggcccttgaagacgggataaattttgcaacagggaacttgcccggttgctccttttctatcttccttcttgctctgttctcctgcttagttcatcctgcagctagtcttgagtggcggaatacgtctggcctctatgtccttaccaacgactgttccaatagcagtattgtgtatgaggccgatgacgtcattctgcacacacccggctgtgtaccttgtgttcaggacgacaatacatccacgtgctggaccccagtgacacctacggtggcagtcaggtacgtcggagcaaccaccgcttcgatacgcagtcatgtggacctattagtgggcgcggccacgctgtgctctgcgctctatgtgggtgatatgtgtggggccgtctttctcgtgggacaagccttcacgttcagacctcgtcgccatcaaacggtccagacctgtaactgctcgctgtacccaggccatgtttcaggacatcgaatggcttgggatatgatgatgaattggtcccccgctgtgggtatggtggtggcgcacatcctgcgattgccccagaccttgtttgacatactggccggggcccattggggcatcttggcgggcctagcctattattctatgcagggcaactgggccaaggtcgctattgtcatgattatgttttcaggggtcgatgctgaaacatatgtcaccggtggcagtgtagctcatagtgccagagggttaactagcctttttagtatgggcgccaagcagaaactgcaattggtcaacaccaatggctcgtggcacatcaacagtactgccctgaactgcaatgagtccataaacaccgggttcatagctgggttgttttattaccataagttcaactctactggatgtcctcaaaggcttagcagctgcaagcccatcatttccttcaggcaggggtggggccccttgacagatgctaacatcaccggtccttctgatgatagaccgtattgctggcactacgcacctagaccttgtagtgttgtcccggcatcaagtgtctgcggccctgtgtactgcttcacaccatcgccagtggtcgtaggcactactgatatcaaaggcaagccgacctacaactggggtgagaatgagacagatgtgttcctgctggagtccctgcggcctcccagtggccggtggtttggatgcgcgtggatgaactccacggggttcctcaagacgtgtggagctcccccttgtaacatctatgggggtgagggggatcccgaaaatgagacagacctcttctgccccaccgactgcttcaggaaacatcctgaggccacatacagccggtgtggtgcggggccctggttgacacctcgctgcatggtcgactatccataccggctttggcattacccatgtacagtcaatttcacattgttcaaggtgaggatgtttgtgggcggatttgaacaccggtttaccgccgcttgtaactggaccaggggggagcgctgcaatatcgaggatcgtgatcgcagcgagcaacatccgctgctgcattcaacaactgagcttgctatactgccttgctctttcacgcccatgcctgcattgtcaacaggtctaatacacctccaccaaaatatcgtggatgtccaatacctttatggtgttggatctgacatggtgggatgggcgctgaaatgggagttcgtcatcctcgttttcctcctcctggcagacgcacgcgtgtgcgttgccctttggctgatgctgatggtatcacaagcagaagcagccttggagaaccttgtcacgctgaacgccgtcgctgctgctgggacacatggtattggttggtacctggtagccttttgcgcggcgtggtacgtgcggggtaaacttgtcccgctgacgagctacggcctgacgggtctttggtccctagcattgcttgtcctcttgctcccccaacgggcgtatgcttggtcgggtgaagacagcgctactctcggcgctggggtcttggccctcttcggcttctttaccttatcaccctggtacaagcattggatcggccgcctcatgtggtggaaccagtacactatatgtagatgcgaggccgcccttcaagtgtgggtcccccccttacttgcacgcgggagtagggacggtgtcatcctgctaacaagcttgctttatccatccttaatttttgacatcactaagctgctgatagcagtaataggcccattatacttaatacaggctgccatcactaccaccccctactttgtgcgcgcacatgtactggtccgcctttgcatgctcgtgcgctccgtgatggggggaaagtacttccagatggccatactgagcattggcagatggttcaacacctacctatatgaccacctagcgccaatgcaacattgggccgcagctggcctcaaagacctagcagtggccactgaacctgtaatatttagtcccatggaaattaaggtcatcacctggggcgcggacacagcggcttgcggagatattctttgcgggctgccggtctccgcgcgattaggccgtgaggtattgttgggacctgctgatgattatcgggaaatgggttggcgtctgttggctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagcaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 73 - DNA, 10281 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacacttcctaaacctcaaagaaaaaccaaaagaaacaccatccgtcgcccacaggacgttaagttcccgggtggcggacagatcgttggtggagtatacgtgttgccgcgcaggggcccacgattgggtgtgcgcgcgacgcgtaaaacttctgaacggtcacagcctcgcggacgacgacagcctatccccaaggcgcgtcggagcgaaggccggtcctgggctcagcccgggtacccttggcccctctatggtaatgagggctgcgggtgggcagggtggctcctgtccccgcgcggctcccgtccatcttggggcccaaacgacccccggcggaggtcccgcaatttgggtaaagtcatcgatacccttacgtgcggattcgccgacctcatggggtacatcccgctcgtcggcgctcccgtaggaggcgtcgcaagagccctcgcgcatggcgtgagggcccttgaagacgggataaattttgcaacagggaacttgcccggttgctccttttctatcttccttcttgctctgttctcctgcttagttcatcctgcagctagtcttgagtggcggaatacgtctggcctctatgtccttaccaacgactgttccaatagcagtattgtgtatgaggccgatgacgtcattctgcacacacccggctgtgtaccttgtgttcaggacgacaatacatccacgtgctggaccccagtgacacctacggtggcagtcaggtacgtcggagcaaccaccgcttcgatacgcagtcatgtggacctattagtgggcgcggccacgctgtgctctgcgctctatgtgggtgatatgtgtggggccgtctttctcgtgggacaagccttcacgttcagacctcgtcgccatcaaacggtccagacctgtaactgctcgctgtacccaggccatgtttcaggacatcgaatggcttgggatatgatgatgaattggtcccccgctgtgggtatggtggtggcgcacatcctgcgattgccccagaccttgtttgacatactggccggggcccattggggcatcttggcgggcctagcctattattctatgcagggcaactgggccaaggtcgctattgtcatgattatgttttcaggggtcgatgctgaaacatatgtcaccggtggcagtgtagctcatagtgccagagggttaactagcctttttagtatgggcgccaagcagaaactgcaattggtcaacaccaatggctcgtggcacatcaacagtactgccctgaactgcaatgagtccataaacaccgggttcatagctgggttgttttattaccataagttcaactctactggatgtcctcaaaggcttagcagctgcaagcccatcatttccttcaggcaggggtggggccccttgacagatgctaacatcaccggtccttctgatgatagaccgtattgctggcactacgcacctagaccttgtagtgttgtcccggcatcaagtgtctgcggccctgtgtactgcttcacaccatcgccagtggtcgtaggcactactgatatcaaaggcaagccgacctacaactggggtgagaatgagacagatgtgttcctgctggagtccctgcggcctcccagtggccggtggtttggatgcgcgtggatgaactccacggggttcctcaagacgtgtggagctcccccttgtaacatctatgggggtgagggggatcccgaaaatgagacagacctcttctgccccaccgactgcttcaggaaacatcctgaggccacatacagccggtgtggtgcggggccctggttgacacctcgctgcatggtcgactatccataccggctttggcattacccatgtacagtcaatttcacattgttcaaggtgaggatgtttgtgggcggatttgaacaccggtttaccgccgcttgtaactggaccaggggggagcgctgcaatatcgaggatcgtgatcgcagcgagcaacatccgctgctgcattcaacaactgagcttgctatactgccttgctctttcacgcccatgcctgcattgtcaacaggtctaatacacctccaccaaaatatcgtggatgtccaatacctttatggtgttggatctgacatggtgggatgggcgctgaaatgggagttcgtcatcctcgttttcctcctcctggcagacgcacgcgtgtgcgttgccctttggctgatgctgatggtatcacaagcagaagcagccttggagaaccttgtcacgctgaacgccgtcgctgctgctgggacacatggtattggttggtacctggtagccttttgcgcggcgtggtacgtgcggggtaaacttgtcccgctgacgatctacggcctgacgggtctttggtccctagcattgcttgtcctcttgctcccccaacgggcgtatgcttggtcgggtgaagacagcgctactctcggcgctggggtcttggccctcttcggcttctttaccttatcaccctggtacaagcattggatcggccgcctcatgtggtggaaccagtacactatatgtagatgcgaggccgcccttcaagtgtgggtcccccccttacttgcacgcgggagtagggacggtgtcatcctgctaacaagcttgctttatccatccttaatttttgacatcactaagctgctgatagcagtaataggcccattatacttaatacaggctgccatcactaccaccccctactttgtgcgcgcacatgtactggtccgcctttgcatgctcgtgcgctccgtgatggggggaaagtacttccagatggccatactgagcattggcagatggttcaacacctacctatatgaccacctagcgccaatgcaacattgggccgcagctggcctcaaagacctagcagtggccactgaacctgtaatatttagtcccatggaaattaaggtcatcacctggggcgcggacacagcggcttgcggagatattctttgcgggctgccggtctccgcgcgattaggccgtgaggtattgttgggacctgctgatgattatcgggaaatgggttggcgtctgttggctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagcaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 74 - DNA, 10263 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacgaatcctaaacctcaaagaaaaaccaaacgtaacaccaaccgccgcccaatggacgttaagttcccgggtggtggccagatcgttggcggagtttacttgttgccgcgcaggggccccagattgggtgtgcgcgcgactcggaagacttcggagcggtcgcaacctcgtggaagacgccaacctatccccaaggcgcgtcgacccgagggaaggtcctgggcacaaccaggatatccatggcctctttacggtaatgagggttgtgggtgggcaggatggctcttgtccccccgtggctctcgaccgtcttggggcccaaatgatccccggcggaggtcccgcaatttgggtaaggtcatcgataccctaacctgcggcttcgccgacctcatgggatacatcccgctcgtaggcgcccccgtgggtggcgtcgccagggccctggcacatggtgtcagggctttggaggacgggatcaattatgcaacagggaatctccccggttgctccttttctatcttcctcttggcacttctttcgtgcctgactgtccccgcttcggccgttaactatcgcaatgtctcgggcatctaccatgtcaccaatgactgcccgaattcaagcatagtgtatgaggccgaccatcacatcttgcaccttccaggttgcgtgccctgcgtgagagaggggaatcagtcacgctgctgggtggcccttactcctaccgtcgcagcgccatacatcggcgcaccgcttgagtccttacggagtcatgtggatttgatggtgggggccgccactgtttgctcgggtctttacatcggggacctgtgtggcggcttgttcctagttggccagatgttttcattccgaccacggcgccactggaccacccaggattgcaattgttccatctacacagggcacattacaggccacagaatggcctgggacatgatgatgaactggagtccaacaaccaccttagttctcgcccaggtcatgaggatcccaaccactctggtagacttactctctggaggccactggggtgtcctcgtgggagtggcctatttcagcatgcaggccaattgggccaaagtcatcttggtcctattcctctttgcaggggttgatgccgagactcacgtgtctggggcagcagtcggccggagtaccgccggcttggctaacctcttttcttctgggtctaagcagaatttacagctcatcaacagcaatgggagctggcatataaataggactgcccttaactgcaatgacagcttaaacactgggttcttggctagcttgttctacacccacaagtttaacagctcagggtgttccgaacggctcgcgtgctgcaagagccttgacagctacggccaaggctggggcccactcggggtcgctaacatcagcggctcgtctgatgacaggccttattgctggcactacgcgcctcggccgtgcgggattgtgccagcatccagtgtgtgtggccccgtgtattgtttcactcccagccctgtcgtggtcggtactactgatcacgtcggggtccctacttacacctggggggagaatgagactgatgtcttccttttgaactcgaccagaccgccgcatggtgcgtggtttggatgcgtgtggatgaacagtaccgggttcaccaaaacctgtggcgcccctccatgcgaggttaacaccaataatgggacctggcactgccccaccgattgcttcaggaagcatccggagactacctacgccaagtgcggatcagggccttggatcacaccgcgctgcctgattgattacccgtaccggctgtggcatttcccgtgcaccgccaacttctccgtctttaacatcaggacatttgtcggcggtatagagcatcggatgcaagcggcatgcaactggaccaggggggaagtctgtggcttggagcacagggatcgcgtagagctatcacccctgctccttaccactacagcgtggcagatcctcccctgctctttcaccactttacctgccctctccaccggcttgatccacctccaccaaaatatcgtggacgtccagtacctctatggtgttgggtctgcagtggtatcttgggcccttaagtgggaatatgtggtgctcgcgttcctgcttctcgcggacgcgagagtctctgcctgcctatggatgatgtttatggtaagtcaagttgaggcggctctgtccaacctgattaacatcaatgctgcttcagccgctggtgcccaaggcttctggtacgccatcctcttcatctgcattgtctggcatgtcaagggccggttcccagctgctgctgcctacgcagcctgcgggctgtggcccctgtttctcctgcttctgatgctgcctgagagggcttatgcatacgaccaggaagtggcagggtcccttggcggcgccatcgttgtcatgctggccattctgacactgtctccgcactacaagttatggctggctaggggattgtggtggatccaatattttatagctaggaccgaggctgtgctgcatgtctatattccatccttcaacgtgcgcgggcctcgcgactcagtgattgttcttgcagtcctggtctgtccacacctagtatttgacatcacaaaatatcttctggccatcttagggcccctccacatactccaggcctcgctcctacgcatcccttactttgtgagggcacaagcgctggttaagatctgcagcttgttgcgtggggtagtttatggcaagtacttccaaatggtcgtgcttaaagcaggggccctgactggtacttacatctatgaccaccttactcccatgtcagattgggccgctacgggcctccgcgatttggcggtggccctagagccagttgtgttctcgcccatggagaagaaagtcatcgtctggggcgctgacaccgctgcgtgcggagacatcataaggggattacctgtttcggccaggttgggcaatgaaatcttgctcggaccagccgatacagaaacatcaaaggggtggagactccttgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 75 - DNA, 10266 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacgaatcctaaacctcaaagaaaaaccaaaagaaacaccaaccgccgcccacaggacgtcaagttcccgggcggtggtcagatcgttggtggagtttacttgttgccgcgcaggggccctaggttgggtgtgcgcgcaactcggaagacttcagaacggtcgcaaccccgtggacggcgtcagcctatccccaaggcgcgccagcccacgggccggtcctggggtcaacccgggtacccttggcccctttatgccaatgagggcctcgggtgggcagggtggttgctctccccccgaggctctcggcctaattggggccccaatgacccccggcggaaatcgcgcaacttgggtaaggtcatcgataccctgacgtgcggattcgccgacctcatggggtacatcccgctcgtaggcggccccgttgggggcgtcgcaagggctctcgcacacggtgtgagggtccttgaggacggggtaaactatgcaacagggaatttacccggttgctctttctctatctttatccttgcacttctttcatgcctgactgtcccgacctctgccgttccctaccgaaatgcctctggggtttatcatgtcaccaatgattgcccaaactcttctatcgtctatgaggctgaagacctgatcttacacgcacctggttgcgtgccctgtgttaggcagggtaatgtcagtaggtgctgggtccagatcacccccacactgtcagccccgagcctcggagcggtcacggctcctcttcggagggccgttgactacttagcggggggggctgccctttgctccgcgttatacgtcggagacgcgtgcggggcagtgtttttggtaggtcaaatgttcacctatagccctcgccggcataatgttgtgcaggactgcaactgttccatttacagtggccacatcaccggccaccggatggcatgggacatgatgatgaattggtcacctacaacagctttggtgatggcccagttgttacggattccccaggtggtcattgacatcattgccggggcccactggggggtcttgttcgccgccgcatactacgcgtcggcggctaactgggccaaggttgtgctggtcctgtttctgtttgcgggggtcgatgccagcacccgcactgtgggtggtagtgcggcccaaggcgcgcgcgggctcgcttcacttttcacccctgggccgcagcagaacttgcagctcataaataccaacgggagctggcacatcaacagaactgcccttaactgtaatgacagcctccagactgggtttgtagccggcctcctgtattatcacaagttcaactccactgggtgtccgcagcggatggctagctgtaggcccctcgccgcattcgaccagggctggggaactatcagctatgccgccgtgtcgggccccagtgatgacaagccctattgctggcactaccccccacgcccgtgcggaatagtgccagcgcgaggtgtctgcggtccggtctattgttttacacctagcccggtggtcgtcggcaccacagaccgcaaggggaatcccacttacagttggggcgaaaatgagactgacatctttctcttgaacaacacgaggccccctactggcaactggtttggctgcacctggatgaattccacagggtttgtcaagacttgcggggctccaccctgcaacttagggcctacaggcaacaatagccttaagtgtcctactgattgcttccgcaagcacccagacgccacctacaccaagtgtgggtcaggaccctggctcactccccggtgtctggtgcattacccttaccggttgtggcattacccgtgcaccctaaattacaccatcttcaaggtgcgcatgtacattgggggcctcgagcacaggctcgaggtggcatgcaactggacccgtggtgagcggtgtgatcttgaagacagggatagggccgagctgagcccgctcctacataccaccacgcagtgggccatattgccgtgctctttcacacccacacccgctcttagcactggtctcatacacttacatcaaaatatagtagacacccagtatctttacggtctgagctccagcatcgtctcgtgggccgttaagtgggagtacatagtgctggccttcttattacttgctgatgcccgtatttgtacttgcctatggatcatgctcctggtttgtcaggccgaagcggccctggagaacgtcattgtcctaaacgcggctgcggctgcggggactcatgggtttttctggggcctgctcgtcatctgcttcgcctggcacttcaagggcaggttggtccctggggccacctacctttgcttgggcatttggccattactcttactccttttcctcctgccccaaagggctctagccctggactcaagcgatggcgggactgtgggttgtcttgtgttaaccatccttacaatcttcacactcacccccgggtacaagaagatggtagtgttggtcatatggtggcttcagtatttcatagcccgggtagaggcctttatccatgtgtgggtgcccccgttgcaggttaggggtggtcgtgatgctattatcatgctcacatgccttttccatcctgccctggggtttgaggtcacgaaaatcctcctcgggatactaggtcctttgtacctgctgcagtactcgctcatcaagctgccttatttcatcagggcgcgcgccctgctgagggcgtgcctgctagcgaagcacttggcctgtggcaggtacgtgcaggcggccttgctccaccttggtaggctgaccggaacgtacatttatgaccaccttgcccccatgaaggattgggcagcgtccgggctgcgcgacttagcagtggccacggagcccatcatattctcccctatggagacgaaggtcatcacgtggggggctgacacggccgcatgtggggacatacttgccggccttcctgtatcagctaggcgaggccatgaaatcttcctggggccagccgatgacatcagagaggggggctggcgacttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaggtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 76 - DNA, 10281 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacacttccaaaaccccaaagaaaaaccaaaagaaacaccaaccgtcgcccaatggacgtcaagttcccgggtggcggtcagatcgttggcggagtttacttgttgccgcgcaggggcccccggttgggtgtgcgcgcgacgaggaagacttccgagcgatcccagcccagaggcaggcgccaacctataccaaaggcgcgccagccccagggcaggcactgggctcagcccggatatccttggcccctttatgggaacgagggctgtgggtgggcaggttggctcctgtccccccgcggctcccggccacactggggccccaacgacccccggcgtcgatcccggaatttgggtaaggtcatcgataccctaacgtgtgggttcgccgatctcatggggtacattcccgtcgtgggcgcgcctttgggcggcgtcgcggctgcactcgcacatggtgtgagggcaatcgaggacgggatcaattatgcaacagggaatcttcccggttgctctttctctatcttcctcttggcactactctcgtgcctcacaacgccagcgtcggctcttacctacggtaactccagtgggctataccatcttacaaatgattgccccaactccagcatcgtgctggaggcggatgccatgatcttgcatttgcctggatgcttgccttgtgtgagggtcaataacaaccagtccatctgttggcatgctgtgtcccccaccctagccataccaaatgcttccacacctgcaacgggattccgtaggcatgtggaccttcttgcgggcgccgcagtggtttgctcatccctgtacatcggggatctgtgcggctccctctttttggcagggcaactatttacctttcagccccgccgtcactggactgtgcaagactgcaactgctccatttatacaggccacgtcaccggccacaggatggcttgggacatgatgatgaattggtcacccacaaccactctggtcctatctagtatcttgagggtacctgagatctgtgcgagtgtgatatctggtggccattgggggatactactagccgttgcctactttggtatggctggcaactggctaaaagttctggctgtcctgttcttatttgcaggggttgaagcaaccaccaccatcggccatcaagtaggccgcactactggtggcttagccagtctcttctccatcggtcccaggcaaaatctacaactcatcaacaccactggcagctggcatataaacaggactgctctgaactgcaatgattccctccagacggggttcataacgtcactcttttatgccaagaacgtcaactcctcgggctgcccagagcggatggctgcgtgtaagcccctcgcggacttccggcaggggtggggccaaataacctacaaagtcaacatctcgggcccctccgacgaccgtccctactgttggcattacgctcccaggccatgtgacgtggtgtcggcccgcacggtgtgcggccccgtttactgcttcacgcccagccctgtcgtagtaggaaccactgacaagctgggcattcccacatacaactggggggagaatgagacggatgtgttcatgttggaaagccttcggcctcctactggaggatggtttgggtgcacgtggatgaactctacgggctttaccaagacctgtggtgccccgccatgtcagatagtcccgggagattacaatagctctgccaatgagcttttgtgccccaccgactgcttccgtaaacatccggaagctacatatcagcggtgtggatcgggaccctggatcacacctaggtgtctggtggattacccctacaggctgtggcactacccctgtactgtcaacttcaccttgcataaagtcaggatgttcgtgggaggcattgagcatcggtttgacgccgcatgtaactggaccagaggcgagcggtgtgatctacatgacagagacaggattgaaatgagcccgctgcttttctcaactacgcagcttgccatacttccctgttcattttccaccatgccggccttgtcaaccggcctcatccacctgcatcagaacatagtggacgtgcagtacctctacggagtctcctcgagcgttacctcgtgggtggtgaagtgggagtacattgttctggtgttcctggttctggcagatgctcggatttgtacatgtctctggttaatgctgctcataaccaacgttgaagcagcagtggaaaggcttgtcgtcctcaatgcggctagcgccgccggcaccgccggctggtggtgggcggtgctcttcctgtgctgtgcttggtacgtgaaaggccgccttgtgcctgcgtgtacctacatggcactgggaatgtggccgttgctcctgacaatcttggccctgcctcgccgagcatacgctatggacaatgagcaagcggcatccctcggagctgttggtctcttggtgctcaccatctttaccatcacccccatgtacaagaagctgttgacctgctccatttggtggaatcagtatttcctcgcccgagctgaggccatgatacacgagtgggtgcccgacctacgggttaggggcggtagggactccatcatcttacttacctgcttgttacatccacagctggggtttgaggtcaccaaaattctactagccatcctggcccctctatacatcctgcagtacagtttgctcaaggtgccttactttgtgcgcgcccacgtactcctgcgtgcttgcctgcttgttcgtaggctagcagggggtaagtacgtgcaggcgtgccttctgaggttgggcgcttggactggcacctttgtctatgaccatctcgcccctctctctgactgggctagcgacggactgcgcgatttggcagtcgcaatcgagccggtcattttctctcccatggagaagaaaatcattacctggggtgcggataccgccgcgtgtggtgacatcttgagtggcctcccggtgtcagcgaggttggggaatttggtgctactgggacccgcggacgatatgcagcgcgggggttggaagcttttggctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 77 - DNA, 10275 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacgaatcctaaacctcaaagattaaccaaaagaaacaccgtccgtcgcccacagaacgttaagttcccgggtggcgggcagatcgttggcggagtctacttgttgccgcgcaggggccctagattgggtgtgcgcggcactaggaagagttcggagcgatcgcagcccaggggaagacgccaacgtatccccaaagctgcctcttcacagggtaaagcctggggcaagcccgggtacccttggcccctgtatggtaacgagggctgtggctgggcagggtggctcctgtccccccgcggctctcgacctacttggggccccactgacccccggcaccgctcgcgaaacctcggtaaggtgatcgacaccatgacctgcgggtttgccgacctcatggggtacatccctgtcctaggcgcccccctagggggcgttgccagggctctggcacatggtgttagagttctggaggacggggtcaactatgcaacagggaacttgcctggttgctccttttctatcttcttactagccctcctgtcatgtctaacagtcccggcatcggcttatgaagtccgcaactccagtggggtctatcatctcaccaatgactgccccaacgctagtatagtctatgaaacagacaacgccatcctacacgagcctgggtgcgtgccttgcgttcgcgagggtaatactagcaggtgttgggaaccagtggcccccactttggcggtccgctatcgcggagcgcttactgacgatttgcggacgcatattgacctagtggtggcgtcagctaccctgtgctccgccttgtacgtgggggacatttgtggagccatcttcattgccagccaagctgttctctggaagcccggggggggtcggatagtgcaagattgcaattgttcgatctacccgggccacgtcaccggccacaggatggcgtgggacatgatgcagaactgggcgccggccttgtcaatggttgccgcttacgctgtgagagtgcccggtgtcatcattaccactgtagcgggcggccactggggtgtgttatttggcctcgcttactttggtatggcgggaaactgggcaaaggtaatactcatcatgctactcatgtccggcgtcgacgcggaaaccatggccgtcggggctagggccgctcacaccactggcgcccttgtcagcctgctcaatccagggcccagtcagcgcctgcagctgatcaacaccaatgggtcatggcacatcaaccggaccgctttgaactgcaatgactctttgcagacagggttcatagcggccctcttctacacacataggttcaattctagtggctgtcccgagaggatggcttcttgtaaacctctcagtgactttgaccaggggtggggcccgctgtggtacaattcaacagaaagaccttcggaccagcgaccctattgctggcactacgcgccatcgccgtgtggtattgtgccggctaaggatgtttgcggtccggtctactgctttacaccaagcccggttgtggtgggcaccacggatcgccggggggtgcccacgtatacttggggtgaaaatgagtctgatgtcttcctgctcaacagcacaaggccgccgcaaggcagttggtttgggtgctcatggatgaacacaacggggttcacgaagacctgcggaggtcctccgtgcaagatacgtccccagggtgcccagagtaacacctctctcacttgtcccacagactgcttcaggaaacatccgcgtgccacatactccgcttgcggatctggtccgtggttgacacctagatgcatggtccattacccctatagactgtggcactacccgtgtacagtcaacttcaccatacacaaagtcaggttatacatagggggtgtagaacataggctcgatgcagcgtgcaattggacgcggggtgagcgatgcgacctggaggaccgagacagggtggacatgtcccccctgctccattccactacggagctcgcaatacttccgtgttcctttgtgccgcttccggccttatctacgggactgatccacctgcaccaaaacatcgttgacgcccagtacctttatggtctttctcccgctataataagctgggccatcagatgggagtgggtagtcctcgttttcctactcctggcggacgcgcggatctgcgcctgcctttggatgatgatgcttatggcccaggctgaagccgctctggagaacttgatccacctcaacgcggccagccttgcgggaacccatggtatctggtggctccttttagtcttttgtgcctcttggcatctacgaggcagggttgtccctctggtgacgtatgggatatgcgggatgtggcccttcttcctcatgttgctgagcctccccccacgagcgtatgctctggacagggaagtgagcgcagcgttgggaacgggcatgctcgccatcatcctattagttaccttgggaccgcactacaagagacttctagcccttattctctggtgggtcacatatttccttacaaggtgtgaagcagcactccaaacgtgggtccctcctctcaaccctcgggggggcagggacggtttcatcctgtgtgtgccgctgtgctatccaggccttgtctttgacatcacaaaatggttgctggtcatgatgtgccctctctacctcctccagttgtgtttggtgaggactccatactttgtgagggcccaggccctcatcagagtgtgttctctcttcaaaacgctagctgggggacggtacgtgcaggccgcgctgctcactattggccgctggaccggcacttatatttataaccatctcgcccccctggaaacatgggccgccggcggcctacgggatttggccgttgcagtcgagcccgtgatattctcccccatggagaagaagatcatagtttggggggcggagaccactgcttgtggcgacattctttgtggcctgcctgtctcagctcggctcggcagggaagtcctgctagggcccgcggatgactacaggtccatgggatggcaactcctggctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgtcatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 78 - DNA, 10266 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 79 - DNA, 10233 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccatggatagcactgagaacgtcatcaagcccttcatgcgcttcaaggtgcacatggagggctccgtgaacggccacgagttcgagatcgagggcgagggcgagggcaagccctacgagggcacccagaccgccaagctgcaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggtgaccgtgacccaggactcctccctgcaggacggcaccttcatctaccacgtgaagttcatcggcgtgaacttcccctccgacggccccgtaatgcagaagaagactctgggctgggagccctccaccgagcgcctgtacccccgcgacggcgtgctgaagggcgagatccacaaggcgctgaagctgaagggcggcggccactacctggtggagttcaagtcaatctacatggccaagaagcccgtgaagctgcccggctactactacgtggactccaagctggacatcacctcccacaacgaggactacaccgtggtggagcagtacgagcgcgccgaggcccgccaccacctgttccagctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 80 - DNA, 10479 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacgaatcctaaacctcaaagaaaaaccaaacgtaacaccaaccgtcgcccacaggacgtcaagttcccgggtggcggtcagatcgttggtggagtttacttgttgccgcgcaggggccctagattgggtgtgcgcgcgacgaggaagacttccgagcggtcgcaacctcgaggtagacgtcagcctatccccaaggcacgtcggcccgagggcaggacctgggctcagcccgggtacccttggcccctctatggcaatgagggttgcgggtgggcgggatggctcctgtctccccgtggctctcggcctagctggggccccacagacccccggcgtaggtcgcgcaatttgggtaaggtcatcgatacccttacgtgcggcttcgccgacctcatggggtacataccgctcgtcggcgcccctcttggaggcgctgccagggccctggcgcatggcgtccgggttctggaagacggcgtgaactatgcaacagggaaccttcctggttgctctttctctatcttccttctggccctgctctcttgcctgactgtgcccgcttcagcctaccaagtgcgcaattcctcggggctttaccatgtcaccaatgattgccctaactcgagtattgtgtacgaggcggccgatgccatcctgcacactccggggtgtgtcccttgcgttcgcgagggtaacgcctcgaggtgttgggtggcggtgacccccacggtggccaccagggacggcaaactccccacaacgcagcttcgacgtcatatcgatctgcttgtcgggagcgccaccctctgctcggccctctacgtgggggacctgtgcgggtctgtctttcttgttggtcaactgtttaccttctctcccaggcgccactggacgacgcaagactgcaattgttctatctatcccggccatataacgggtcatcgcatggcatgggatatgatgatgaactggtcccctacggcagcgttggtggtagctcagctgctccggatcccacaagccatcatggacatgatcgctggtgctcactggggagtcctggcgggcatagcgtatttctccatggtggggaactgggcgaaggtcctggtagtgctgctgctatttgccggcgtcgacgcggaaacccacgtcaccgggggaaatgccggccgcaccacggctgggcttgttggtctccttacaccaggcgccaagcagaacatccaactgatcaacaccaacggcagttggcacatcaatagcacggccttgaattgcaatgaaagccttaacaccggctggttagcagggctcttctatcaacacaaattcaactcttcaggctgtcctgagaggttggccagctgccgacgccttaccgattttgcccagggctggggtcctatcagttatgccaacggaagcggcctcgacgaacgcccctactgctggcactaccctccaagaccttgtggcattgtgcccgcaaagagcgtgtgtggcccggtatattgcttcactcccagccccgtggtggtgggaacgaccgacaggtcgggcgcgcctacctacagctggggtgcaaatgatacggatgtcttcgtccttaacaacaccaggccaccgctgggcaattggttcggttgtacctggatgaactcaactggattcaccaaagtgtgcggagcgcccccttgtgtcatcggaggggtgggcaacaacaccttgctctgccccactgattgcttccgcaaacatccggaagccacatactctcggtgcggctccggtccctggattacacccaggtgcatggtcgactacccgtataggctttggcactatccttgtaccatcaattacaccatattcaaagtcaggatgtacgtgggaggggtcgagcacaggctggaagcggcctgcaactggacgcggggcgaacgctgtgatctggaagacagggacaggtccgagctcagcccgttgctgctgtccaccacacagtggcaggtccttccgtgttctttcacgaccctgccagccttgtccaccggcctcatccacctccaccagaacattgtggacgtgcagtacttgtacggggtagggtcaagcatcgcgtcctgggccattaagtgggagtacgtcgttctcctgttccttctgcttgcagacgcgcgcgtctgctcctgcttgtggatgatgttactcatatcccaagcggaggcggctttggagaacctcgtaatactcaatgcagcatccctggccgggacgcacggtcttgtgtccttcctcgtgttcttctgctttgcgtggtatctgaagggtaggtgggtgcccggagcggcctacgccctctacgggatgtggcctctcctcctgctcctgctggcgttgcctcagcgggcatacgcactggacacggaggtggccgcgtcgtgtggcggcgttgttcttgtcgggttaatggcgctgactctgtcgccatattacaagcgctatatcagctggtgcatgtggtggcttcagtattttctgaccagagtagaagcgcaactgcacgtgtgggttccccccctcaacgtccggggggggcgcgatgccgtcatcttactcatgtgtgtagtacacccgaccctggtatttgacatcaccaaactactcctggccatcttcggacccctttggattcttcaagccagtttgcttaaagtcccctacttcgtgcgcgttcaaggccttctccggatctgcgcgctagcgcggaagatagccggaggtcattacgtgcaaatggccatcatcaagttaggggcgcttactggcacctatgtgtataaccatctcacccctcttcgagactgggcgcacaacggcctgcgagatctggccgtggctgtggaaccagtcgtcttctcccgaatggagaccaagctcatcacgtggggggcagataccgccgcgtgcggtgacatcatcaacggcttgcccgtctctgcccgtaggggccaggagatactgcttgggccagccgacggaatggtctccaaggggtggaggttgctggctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgccctggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccatggcttccaaggtgtacgaccccgagcaacgcaaacgcatgatcactgggcctcagtggtgggctcgctgcaagcaaatgaacgtgctggactccttcatcaactactatgattccgagaagcacgccgagaacgccgtgatttttctgcatggtaacgctgcctccagctacctgtggaggcacgtcgtgcctcacatcgagcccgtggctagatgcatcatccctgatctgatcggaatgggtaagtccggcaagagcgggaatggctcatatcgcctcctggatcactacaagtacctcaccgcttggttcgagctgctgaaccttccaaagaaaatcatctttgtgggccacgactggggggcttgtctggcctttcactactcctacgagcaccaagacaagatcaaggccatcgtccatgctgagagtgtcgtggacgtgatcgagtcctgggacgagtggcctgacatcgaggaggatatcgccctgatcaagagcgaagagggcgagaaaatggtgcttgagaataacttcttcgtcgagaccatgctcccaagcaagatcatgcggaaactggagcctgaggagttcgctgcctacctggagccattcaaggagaagggcgaggttagacggcctaccctctcctggcctcgcgagatccctctcgttaagggaggcaagcccgacgtcgtccagattgtccgcaactacaacgcctaccttcgggccagcgacgatctgcctaagatgttcatcgagtccgaccctgggttcttttccaacgctattgtcgagggagctaagaagttccctaacaccgagttcgtgaaggtgaagggcctccacttcagccaggaggacgctccagatgaaatgggtaagtacatcaagagcttcgtggagcgcgtgctgaagaacgagcagctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 81 - DNA, 10479 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacgaatcctaaacctcaaagaaaaaccaaacgtaacaccaaccgtcgcccacaggacgtcaagttcccgggtggcggtcagatcgttggtggagtttacttgttgccgcgcaggggccctagattgggtgtgcgcgcgacgaggaagacttccgagcggtcgcaacctcgaggtagacgtcagcctatccccaaggcgcgtcggcccgagggcaggacctgggctcagcccgggtacccttggcccctctatggcaatgagggttgcgggtgggcgggatggctcctgtctccccgtggctctcggcctagctggggccccacggacccccggcgtaggtcgcgcaatttgggtaaggtcatcgatacccttacgtgcggcttcgccgacctcatggggtacataccgctcgtcggcgcccctcttggaggcgctgccagggccctggcgcatggcgtccgggttttggaagacggcgtgaactatgcaacagggaaccttcctggttgctctttctctattttccttctggccctgctctcttgtctgactggacccgcttcagcctaccaagtgcgcaactccacggggctttaccatgtcaccaatgattgccccaactcgagcattgtgttcgaggcggctgatgccatcctgcacactccggggtgtgtcccttgcgtacgcgagggtaacgcctcgaggtgttgggtggcggtaacccccacggtggccaccagggatggcaaactccccacaacgcagcttcgacgtcacatcgatctgcttgtcgggagcgccaccctctgctcggccctttacgtgggggacctgtgcgggtctgtctttcttgttggtcaactgttcaccttctctcccaggcgccactggacgacgcaagattgcaattgttctatctaccccggccatatttcaggtcaccgtatggcatgggatatgatgatgaactggtcccctacggcggcgttgttggtagctcagctgctccggatcccacaagccatcctggacatgatcgctggtgctcactggggagtcctggcgggcatggcgtatttctccatggtggggaactgggcgaaggttctggtagtgctgctgctatttgccggcgtcgacgcggaaacctacgtcaccgggggaagtgccgcccgtactacggctggacttgctagtcttttctcaccaggcgccaagcagaacatccagctggtcaacaccaacggcagttggcacatcaatagcacggccttgaactgcaatgacagcctcaacaccggctggatagcaggacttttctatcaccacaaattcaactcttcgggctgttccgagaggttagccagctgccgaccccttaccgattttgcccagggctggggccctatcagtcacgccgacggaagtggccccgaccaacgcccctactgctggcactaccctccaaaaccttgtggtattgtgcccgcaaagagcgtgtgtggcccggtatattgtttcactcccagtcccgtggtggtgggaacgaccgacaggtcgggcgcgcctacctacagctggggtgcaaatgacacggacgtcttcgtccttaacaacaccaggccaccgctgggcaattggttcggttgcacctggatgaactcaactggattcaccaaagtgtgcggagcgcccccttgcgtcatcggaggggtgggcaacaacaccttgcgctgccccactgattgtttccgcaagcatccggaagccacatactctcggtgcggctccggtccctggattacgcccaggtgcctggtcgactacccgtataggctttggcattatccttgtaccatcaactacaccgtgtttaaagtcaggatgtacgtgggaggggtcgagcacaggctggaagctgcctgcaactggacgcggggcgaccgttgtaatctggatgacagggacaggtccgagctcagcccgctgctgctgtccactacgcagtggcaggtcctcccgtgttccttcacgaccctgccagccttgtccaccggcctcatccacctccaccaaaacatcgtggacgtgcaatacttgtacggggtgggatcaagcatcgcgtcctgggccatcaagtgggaatacgtcgttctcttgttccttctgcttgcagacgcgcgcgtctgctcctgcttgtggatgatgttactcatatcccaagtggaggcggctttggagaacctcgtagtactcaatgcagcatccctggccgggacacacggtcttgtatccttcctcgtgttcttctgctttgcatggtatctgaagggtaagtgggtgcccggagcggcctacgccctctacgggatgtggcctctcctcttgctcctgttagcgttgccccagcgggcatacgcactggacacggaggtggccgcgtcgtgtggcggcgttgttcttgtcgggttaatggcgctgactctgtcaccatattacaagcgctatatcagctggtgcttgtggtggcttcagtatttcctgaccagaatagaagcgcaactgcacgtgtggattccccctctcaacgtccggggggggcgcgatgccgtcatcttactcatgtgtgttgtgcacccggctctggtatttgacatcaccaagctactgctggctgccttcgggcccctttggattcttcaagccagtttgcttaaggtaccctacttcgtgcgcgttcaaggccttctccggatctgcgcgctagcgcggaagatggctggaggccattacgtgcaaatggccatcatcaagttaggggcgcttactggcacttatgtttacaaccatctcaccccccttcgggactgggcgcacaacggcctgcgagatctggccgtggctgtggagccagtcgtcttctcccgaatggagaccaagcttatcacctggggggcagacaccgccgcgtgcggtgacatcatcaacggcttgcccgtctccgcccggaggggccgggagatactgctcgggccagccgatggaatggtctccaaggggtggagattgctggctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgccctggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccatggcttccaaggtgtacgaccccgagcaacgcaaacgcatgatcactgggcctcagtggtgggctcgctgcaagcaaatgaacgtgctggactccttcatcaactactatgattccgagaagcacgccgagaacgccgtgatttttctgcatggtaacgctgcctccagctacctgtggaggcacgtcgtgcctcacatcgagcccgtggctagatgcatcatccctgatctgatcggaatgggtaagtccggcaagagcgggaatggctcatatcgcctcctggatcactacaagtacctcaccgcttggttcgagctgctgaaccttccaaagaaaatcatctttgtgggccacgactggggggcttgtctggcctttcactactcctacgagcaccaagacaagatcaaggccatcgtccatgctgagagtgtcgtggacgtgatcgagtcctgggacgagtggcctgacatcgaggaggatatcgccctgatcaagagcgaagagggcgagaaaatggtgcttgagaataacttcttcgtcgagaccatgctcccaagcaagatcatgcggaaactggagcctgaggagttcgctgcctacctggagccattcaaggagaagggcgaggttagacggcctaccctctcctggcctcgcgagatccctctcgttaagggaggcaagcccgacgtcgtccagattgtccgcaactacaacgcctaccttcgggccagcgacgatctgcctaagatgttcatcgagtccgaccctgggttcttttccaacgctattgtcgagggagctaagaagttccctaacaccgagttcgtgaaggtgaagggcctccacttcagccaggaggacgctccagatgaaatgggtaagtacatcaagagcttcgtggagcgcgtgctgaagaacgagcagctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 82 - DNA, 10479 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacgaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaaggcttccgagcggtcgcaacctcgtggaaggcgacaacctatcccaaaggctcgccgacccgagggcagggcctgggctcagcccgggtacccttggcccctctatggcaatgagggcctggggtgggcaggatggctcctgtcaccccgcggctcccggcctagttggggccccacggacccccggcgtaggtcgcgtaacttgggtaaggtcatcgatacccttacatgcggcttcgccgatctcatggggtacattccgctcgtcggcgcccccctagggggcgctgccagggccttggcacacggtgtccgggttctggaggacggcgtgaactatgcaacagggaacttgcccggttgctctttctctatcttcctcttggctctgctgtcctgtttgaccatcccagcttccgcttatgaagtgcgcaacgtgtccgggatataccatgtcacgaacgactgctccaactcaagcattgtgtatgaggcagcggacgtgatcatgcatactcccgggtgcgtgccctgtgttcaggagggtaacagctcccgttgctgggtagcgctcactcccacgctcgcggccaggaatgccagcgtccccactacgacaatacgacgccacgtcgacttgctcgttgggacggctgctttctgctccgctatgtacgtgggggatctctgcggatctattttcctcgtctcccagctgttcaccttctcgcctcgccggcatgagacagtgcaggactgcaactgctcaatctatcccggccatgtatcaggtcaccgcatggcttgggatatgatgatgaactggtcacctacaacagccctagtggtgtcgcagttgctccggatcccacaagctgtcgtggacatggtggcgggggcccactggggagtcctggcgggccttgcctactattccatggtagggaactgggctaaggttctgattgtggcgctactctttgccggcgttgacggggagacccacacgacggggagggtggccggccacaccacctccgggttcacgtcccttttctcatctggggcgtctcagaaaatccagcttgtgaataccaacggcagctggcacatcaacaggactgccctaaattgcaatgactccctccaaactgggttctttgccgcgctgttttacgcacacaagttcaactcgtccgggtgcccggagcgcatggccagctgccgccccattgactggttcgcccaggggtggggccccatcacctatactaagcctaacagctcggatcagaggccttattgctggcattacgcgcctcgaccgtgtggtgtcgtacccgcgtcgcaggtgtgtggtccagtgtattgtttcaccccaagccctgttgtggtggggaccaccgatcgttccggtgtccctacgtatagctggggggagaatgagacagacgtgatgctcctcaacaacacgcgtccgccacaaggcaactggttcggctgtacatggatgaatagtactgggttcactaagacgtgcggaggtcccccgtgtaacatcgggggggtcggtaaccgcaccttgatctgccccacggactgcttccggaagcaccccgaggctacttacacaaaatgtggctcggggccctggttgacacctaggtgcctagtagactacccatacaggctttggcactacccctgcactctcaatttttccatctttaaggttaggatgtatgtggggggcgtggagcacaggctcaatgccgcatgcaattggactcgaggagagcgctgtaacttggaggacagggataggtcagaactcagcccgctgctgctgtctacaacagagtggcagatactgccctgtgctttcaccaccctaccggctttatccactggtttgatccatctccatcagaacatcgtggacgtgcaatacctgtacggtgtagggtcagcgtttgtctcctttgcaatcaaatgggagtacatcctgttgcttttccttctcctggcagacgcgcgcgtgtgtgcctgcttgtggatgatgctgctgatagcccaggctgaggccgccttagagaacttggtggtcctcaatgcggcgtccgtggccggagcgcatggtattctctcctttcttgtgttcttctgcgccgcctggtacattaagggcaggctggctcctggggcggcgtatgctttttatggcgtatggccgctgctcctgctcctactggcgttaccaccacgagcttacgccttggaccgggagatggctgcatcgtgcgggggtgcggttcttgtaggtctggtattcttgaccttgtcaccatactacaaagtgtttctcactaggctcatatggtggttacaatactttatcaccagagccgaggcgcacatgcaagtgtgggtcccccccctcaacgttcggggaggccgcgatgccatcatcctcctcacgtgtgcggttcatccagagttaattcttgacatcaccaaactcctgctcgccatactcggcccgctcatggtgctccaggctggcataacgagagtgccgtacttcgtgcgcgctcaagggctcattcgtgcatgcatgttagtgcgaaaagtcgccgggggtcattatgtccaaatggtcttcatgaagctgggcgcgctgacaggtacgtacgtttataaccatcttaccccactgcgggactgggcccacgcgggcctacgagaccttgcggtggcggtagagcccgtcgtcttctccgccatggagaccaaggtcatcacctggggagcagacaccgctgcgtgtggggacatcatcttgggtctacccgtctccgcccgaagggggaaggagatatttttgggaccggctgatagtctcgaagggcaagggtggcgactccttgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagactgggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccatggcttccaaggtgtacgaccccgagcaacgcaaacgcatgatcactgggcctcagtggtgggctcgctgcaagcaaatgaacgtgctggactccttcatcaactactatgattccgagaagcacgccgagaacgccgtgatttttctgcatggtaacgctgcctccagctacctgtggaggcacgtcgtgcctcacatcgagcccgtggctagatgcatcatccctgatctgatcggaatgggtaagtccggcaagagcgggaatggctcatatcgcctcctggatcactacaagtacctcaccgcttggttcgagctgctgaaccttccaaagaaaatcatctttgtgggccacgactggggggcttgtctggcctttcactactcctacgagcaccaagacaagatcaaggccatcgtccatgctgagagtgtcgtggacgtgatcgagtcctgggacgagtggcctgacatcgaggaggatatcgccctgatcaagagcgaagagggcgagaaaatggtgcttgagaataacttcttcgtcgagaccatgctcccaagcaagatcatgcggaaactggagcctgaggagttcgctgcctacctggagccattcaaggagaagggcgaggttagacggcctaccctctcctggcctcgcgagatccctctcgttaagggaggcaagcccgacgtcgtccagattgtccgcaactacaacgcctaccttcgggccagcgacgatctgcctaagatgttcatcgagtccgaccctgggttcttttccaacgctattgtcgagggagctaagaagttccctaacaccgagttcgtgaaggtgaagggcctccacttcagccaggaggacgctccagatgaaatgggtaagtacatcaagagcttcgtggagcgcgtgctgaagaacgagcagctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 83 - DNA, 10491 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaaccaaaagaaacacaaaccgccgcccacaggacgttaagttcccgggtggcggtcagatcgttggcggagtttacttgctgccgcgcaggggccccaggttgggtgtgcgcgcgacaaggaagacttctgagcgatcccagccgcgtggacgacgccagcccatcccgaaagatcggcgctccaccggcaagtcctggggaaagccaggatatccttggcccctgtacggaaacgagggttgcggctgggcgggttggctcctgtccccccgcgggtctcgtcctacttggggccccaccgacccccggcatagatcacgcaatttgggcagagtcatcgataccattacgtgtggttttgccgacctcatggggtacatccctgtcgttggcgccccggttggaggcgtcgccagagctctggcacacggtgttagggtcctggaggacgggataaattacgcaacagggaatttacccggttgctctttttctatctttttgcttgctcttctgtcatgcgtcacagtgccagtgtctgcagtggaagtcaggaacattagttctagctactacgccactaatgattgctcaaacaacagcatcacctggcagctcactgacgcagttctccatcttcctggatgcgtcccatgtgagaatgataatggcaccttgcattgctggatacaagtaacacccaacgtggctgtgaaacaccgcggtgcgctcactcgtagcctgcgaacacacgtcgacatgatcgtaatggcagctacggcctgctcggccttgtatgtgggagatgtgtgcggggccgtgatgattctatcgcaggctttcatggtatcaccacaacgccacaacttcacccaagagtgcaactgttccatctaccaaggtcacatcaccggccatcgcatggcatgggacatgatgctgaactggtctccaactcttgccatgatcctcgcctacgccgctcgtgttcccgagatggtcctcgaaattattttcggcggccattggggtgtggtgtttggcttggcctacttctccatgcaaggagcgtgggccaaagtcattgccatcctccttcttgttgcgggagtggatgcaaccacctattccagcggccaggaagcgggtcgtaccgtcttggggttcactaacctctttacttctggtgccaagcagaacctctatttaatcaacaccaatggcagctggcacataaaccggactgccctcaattgcaatgacagcttacagacgggtttcatggcttccctgttttacacccacaggttcaacagctctggctgccccgagcgcttgtcttcctgccgcgggctggacgattttcgcatcggctggggaaccttggaatacgaaacccacgtcaccaacgatgaggacatgaggccgtactgctggcattaccctccgaggccttgcggcatcgtcccggctagaacggtttgcggaccggtctattgtttcacccctagccctgttgtcgtgggcaccactgacaagcagggcgtacccacctacacctggggggaaaacgagaccgatgtcttcctgctgaatagcacaagacccccgcgaggagcttggttcggctgcacttggatgaacgggactgggttcactaagacatgcggtgcaccaccttgccgcattaggaaagactacaacagcactatcgatttattgtgccccacagactgttttaggaagcaccccgatgctacctatcttaagtgtggagcagggccttggttaactcccaggtgcctggtagactacccttatagactgtggcattatccgtgcactgtaaacttcaccatctttaaggcgcggatgtatgtaggaggggtggagcatcgattctccgcagcatgcaacttcacgcgcggagatcgctgcagactggaagatagggataggggtcagcagagtccactgctgcattccactactgagtgggcggtgctcccatgctccttctctgacctaccagcactatccactggcctattgcacctccaccaaaacatcgtggacgtgcagtacctttacggactttctccggctctgacaagatacatcgtgaagtgggagtgggtgatcctccttttcttgttgttggcagacgccaggatctgtgcatgcctttggatgctcatcatactgggccaagccgaagcggcgcttgagaagctcatcatcttgcactccgctagtgctgctagtgccaatggtccgctgtggtttttcatcttctttacagcggcctggtacttaaagggcagggtggtccccgtggccacgtactctgttctcggcttatggtccttcctcctcctagtcctggccttaccacagcaggcttatgccttggacgctgctgaacaaggggaactggggctggccatattagtaattatatccatctttactcttaccccagcatacaagatcctcctgagccgttcagtgtggtggctgtcctacatgctggtcttggccgaggcccagattcagcaatgggttccccccctggaggtccgaggggggcgtgacggaatcatctgggtggctgtcattctacacccacgccttgtgtttgaggtcacgaaatggttgttagcaatcctggggcctgcctacctccttaaagcgtctctgctacggataccgtactttgtgagggcccacgctttgctacgagtgtgtaccctggtgaaacacctcgcgggggctaggtacatccagatgctgttgatcaccataggcagatggaccggcacttacatctacgaccacctctcccctttatcaacttgggcggcccagggtttgcgggacctggcaatcgccgtggagcctgtggtgttcagcccaatggagaagaaggtcattgtgtggggggctgagacagtggcgtgtggagacatcctgcatggcctcccggtctccgcgaggctaggtagggaggttctgctcggccctgccgacggctacacctccaaggggtggaagctcctagctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccatggcttccaaggtgtacgaccccgagcaacgcaaacgcatgatcactgggcctcagtggtgggctcgctgcaagcaaatgaacgtgctggactccttcatcaactactatgattccgagaagcacgccgagaacgccgtgatttttctgcatggtaacgctgcctccagctacctgtggaggcacgtcgtgcctcacatcgagcccgtggctagatgcatcatccctgatctgatcggaatgggtaagtccggcaagagcgggaatggctcatatcgcctcctggatcactacaagtacctcaccgcttggttcgagctgctgaaccttccaaagaaaatcatctttgtgggccacgactggggggcttgtctggcctttcactactcctacgagcaccaagacaagatcaaggccatcgtccatgctgagagtgtcgtggacgtgatcgagtcctgggacgagtggcctgacatcgaggaggatatcgccctgatcaagagcgaagagggcgagaaaatggtgcttgagaataacttcttcgtcgagaccatgctcccaagcaagatcatgcggaaactggagcctgaggagttcgctgcctacctggagccattcaaggagaagggcgaggttagacggcctaccctctcctggcctcgcgagatccctctcgttaagggaggcaagcccgacgtcgtccagattgtccgcaactacaacgcctaccttcgggccagcgacgatctgcctaagatgttcatcgagtccgaccctgggttcttttccaacgctattgtcgagggagctaagaagttccctaacaccgagttcgtgaaggtgaagggcctccacttcagccaggaggacgctccagatgaaatgggtaagtacatcaagagcttcgtggagcgcgtgctgaagaacgagcagctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 84 - DNA, 10497 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacacttcctaaacctcaaagaaaaaccaaaagaaacaccatccgtcgcccacaggacgttaagttcccgggtggcggacagatcgttggtggagtatacgtgttgccgcgcaggggcccacgattgggtgtgcgcgcgacgcgtaaaacttctgaacggtcacagcctcgcggacgacgacagcctatccccaaggcgcgtcggagcgaaggccggtcctgggctcagcccgggtacccttggcccctctatggtaatgagggctgcgggtgggcagggtggctcctgtccccgcgcggctcccgtccatcttggggcccaaacgacccccggcggaggtcccgcaatttgggtaaagtcatcgatacccttacgtgcggattcgccgacctcatggggtacatcccgctcgtcggcgctcccgtaggaggcgtcgcaagagccctcgcgcatggcgtgagggcccttgaagacgggataaattttgcaacagggaacttgcccggttgctccttttctatcttccttcttgctctgttctcctgcttagttcatcctgcagctagtcttgagtggcggaatacgtctggcctctatgtccttaccaacgactgttccaatagcagtattgtgtatgaggccgatgacgtcattctgcacacacccggctgtgtaccttgtgttcaggacgacaatacatccacgtgctggaccccagtgacacctacggtggcagtcaggtacgtcggagcaaccaccgcttcgatacgcagtcatgtggacctattagtgggcgcggccacgctgtgctctgcgctctatgtgggtgatatgtgtggggccgtctttctcgtgggacaagccttcacgttcagacctcgtcgccatcaaacggtccagacctgtaactgctcgctgtacccaggccatgtttcaggacatcgaatggcttgggatatgatgatgaattggtcccccgctgtgggtatggtggtggcgcacatcctgcgattgccccagaccttgtttgacatactggccggggcccattggggcatcttggcgggcctagcctattattctatgcagggcaactgggccaaggtcgctattgtcatgattatgttttcaggggtcgatgctgaaacatatgtcaccggtggcagtgtagctcatagtgccagagggttaactagcctttttagtatgggcgccaagcagaaactgcaattggtcaacaccaatggctcgtggcacatcaacagtactgccctgaactgcaatgagtccataaacaccgggttcatagctgggttgttttattaccataagttcaactctactggatgtcctcaaaggcttagcagctgcaagcccatcatttccttcaggcaggggtggggccccttgacagatgctaacatcaccggtccttctgatgatagaccgtattgctggcactacgcacctagaccttgtagtgttgtcccggcatcaagtgtctgcggccctgtgtactgcttcacaccatcgccagtggtcgtaggcactactgatatcaaaggcaagccgacctacaactggggtgagaatgagacagatgtgttcctgctggagtccctgcggcctcccagtggccggtggtttggatgcgcgtggatgaactccacggggttcctcaagacgtgtggagctcccccttgtaacatctatgggggtgagggggatcccgaaaatgagacagacctcttctgccccaccgactgcttcaggaaacatcctgaggccacatacagccggtgtggtgcggggccctggttgacacctcgctgcatggtcgactatccataccggctttggcattacccatgtacagtcaatttcacattgttcaaggtgaggatgtttgtgggcggatttgaacaccggtttaccgccgcttgtaactggaccaggggggagcgctgcaatatcgaggatcgtgatcgcagcgagcaacatccgctgctgcattcaacaactgagcttgctatactgccttgctctttcacgcccatgcctgcattgtcaacaggtctaatacacctccaccaaaatatcgtggatgtccaatacctttatggtgttggatctgacatggtgggatgggcgctgaaatgggagttcgtcatcctcgttttcctcctcctggcagacgcacgcgtgtgcgttgccctttggctgatgctgatggtatcacaagcagaagcagccttggagaaccttgtcacgctgaacgccgtcgctgctgctgggacacatggtattggttggtacctggtagccttttgcgcggcgtggtacgtgcggggtaaacttgtcccgctgacgagctacggcctgacgggtctttggtccctagcattgcttgtcctcttgctcccccaacgggcgtatgcttggtcgggtgaagacagcgctactctcggcgctggggtcttggccctcttcggcttctttaccttatcaccctggtacaagcattggatcggccgcctcatgtggtggaaccagtacactatatgtagatgcgaggccgcccttcaagtgtgggtcccccccttacttgcacgcgggagtagggacggtgtcatcctgctaacaagcttgctttatccatccttaatttttgacatcactaagctgctgatagcagtaataggcccattatacttaatacaggctgccatcactaccaccccctactttgtgcgcgcacatgtactggtccgcctttgcatgctcgtgcgctccgtgatggggggaaagtacttccagatggccatactgagcattggcagatggttcaacacctacctatatgaccacctagcgccaatgcaacattgggccgcagctggcctcaaagacctagcagtggccactgaacctgtaatatttagtcccatggaaattaaggtcatcacctggggcgcggacacagcggcttgcggagatattctttgcgggctgccggtctccgcgcgattaggccgtgaggtattgttgggacctgctgatgattatcgggaaatgggttggcgtctgttggctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagcaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccatggcttccaaggtgtacgaccccgagcaacgcaaacgcatgatcactgggcctcagtggtgggctcgctgcaagcaaatgaacgtgctggactccttcatcaactactatgattccgagaagcacgccgagaacgccgtgatttttctgcatggtaacgctgcctccagctacctgtggaggcacgtcgtgcctcacatcgagcccgtggctagatgcatcatccctgatctgatcggaatgggtaagtccggcaagagcgggaatggctcatatcgcctcctggatcactacaagtacctcaccgcttggttcgagctgctgaaccttccaaagaaaatcatctttgtgggccacgactggggggcttgtctggcctttcactactcctacgagcaccaagacaagatcaaggccatcgtccatgctgagagtgtcgtggacgtgatcgagtcctgggacgagtggcctgacatcgaggaggatatcgccctgatcaagagcgaagagggcgagaaaatggtgcttgagaataacttcttcgtcgagaccatgctcccaagcaagatcatgcggaaactggagcctgaggagttcgctgcctacctggagccattcaaggagaagggcgaggttagacggcctaccctctcctggcctcgcgagatccctctcgttaagggaggcaagcccgacgtcgtccagattgtccgcaactacaacgcctaccttcgggccagcgacgatctgcctaagatgttcatcgagtccgaccctgggttcttttccaacgctattgtcgagggagctaagaagttccctaacaccgagttcgtgaaggtgaagggcctccacttcagccaggaggacgctccagatgaaatgggtaagtacatcaagagcttcgtggagcgcgtgctgaagaacgagcagctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 85 - DNA, 10479 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacgaatcctaaacctcaaagaaaaaccaaacgtaacaccaaccgccgcccaatggacgttaagttcccgggtggtggccagatcgttggcggagtttacttgttgccgcgcaggggccccagattgggtgtgcgcgcgactcggaagacttcggagcggtcgcaacctcgtggaagacgccaacctatccccaaggcgcgtcgacccgagggaaggtcctgggcacaaccaggatatccatggcctctttacggtaatgagggttgtgggtgggcaggatggctcttgtccccccgtggctctcgaccgtcttggggcccaaatgatccccggcggaggtcccgcaatttgggtaaggtcatcgataccctaacctgcggcttcgccgacctcatgggatacatcccgctcgtaggcgcccccgtgggtggcgtcgccagggccctggcacatggtgtcagggctttggaggacgggatcaattatgcaacagggaatctccccggttgctccttttctatcttcctcttggcacttctttcgtgcctgactgtccccgcttcggccgttaactatcgcaatgtctcgggcatctaccatgtcaccaatgactgcccgaattcaagcatagtgtatgaggccgaccatcacatcttgcaccttccaggttgcgtgccctgcgtgagagaggggaatcagtcacgctgctgggtggcccttactcctaccgtcgcagcgccatacatcggcgcaccgcttgagtccttacggagtcatgtggatttgatggtgggggccgccactgtttgctcgggtctttacatcggggacctgtgtggcggcttgttcctagttggccagatgttttcattccgaccacggcgccactggaccacccaggattgcaattgttccatctacacagggcacattacaggccacagaatggcctgggacatgatgatgaactggagtccaacaaccaccttagttctcgcccaggtcatgaggatcccaaccactctggtagacttactctctggaggccactggggtgtcctcgtgggagtggcctatttcagcatgcaggccaattgggccaaagtcatcttggtcctattcctctttgcaggggttgatgccgagactcacgtgtctggggcagcagtcggccggagtaccgccggcttggctaacctcttttcttctgggtctaagcagaatttacagctcatcaacagcaatgggagctggcatataaataggactgcccttaactgcaatgacagcttaaacactgggttcttggctagcttgttctacacccacaagtttaacagctcagggtgttccgaacggctcgcgtgctgcaagagccttgacagctacggccaaggctggggcccactcggggtcgctaacatcagcggctcgtctgatgacaggccttattgctggcactacgcgcctcggccgtgcgggattgtgccagcatccagtgtgtgtggccccgtgtattgtttcactcccagccctgtcgtggtcggtactactgatcacgtcggggtccctacttacacctggggggagaatgagactgatgtcttccttttgaactcgaccagaccgccgcatggtgcgtggtttggatgcgtgtggatgaacagtaccgggttcaccaaaacctgtggcgcccctccatgcgaggttaacaccaataatgggacctggcactgccccaccgattgcttcaggaagcatccggagactacctacgccaagtgcggatcagggccttggatcacaccgcgctgcctgattgattacccgtaccggctgtggcatttcccgtgcaccgccaacttctccgtctttaacatcaggacatttgtcggcggtatagagcatcggatgcaagcggcatgcaactggaccaggggggaagtctgtggcttggagcacagggatcgcgtagagctatcacccctgctccttaccactacagcgtggcagatcctcccctgctctttcaccactttacctgccctctccaccggcttgatccacctccaccaaaatatcgtggacgtccagtacctctatggtgttgggtctgcagtggtatcttgggcccttaagtgggaatatgtggtgctcgcgttcctgcttctcgcggacgcgagagtctctgcctgcctatggatgatgtttatggtaagtcaagttgaggcggctctgtccaacctgattaacatcaatgctgcttcagccgctggtgcccaaggcttctggtacgccatcctcttcatctgcattgtctggcatgtcaagggccggttcccagctgctgctgcctacgcagcctgcgggctgtggcccctgtttctcctgcttctgatgctgcctgagagggcttatgcatacgaccaggaagtggcagggtcccttggcggcgccatcgttgtcatgctggccattctgacactgtctccgcactacaagttatggctggctaggggattgtggtggatccaatattttatagctaggaccgaggctgtgctgcatgtctatattccatccttcaacgtgcgcgggcctcgcgactcagtgattgttcttgcagtcctggtctgtccacacctagtatttgacatcacaaaatatcttctggccatcttagggcccctccacatactccaggcctcgctcctacgcatcccttactttgtgagggcacaagcgctggttaagatctgcagcttgttgcgtggggtagtttatggcaagtacttccaaatggtcgtgcttaaagcaggggccctgactggtacttacatctatgaccaccttactcccatgtcagattgggccgctacgggcctccgcgatttggcggtggccctagagccagttgtgttctcgcccatggagaagaaagtcatcgtctggggcgctgacaccgctgcgtgcggagacatcataaggggattacctgtttcggccaggttgggcaatgaaatcttgctcggaccagccgatacagaaacatcaaaggggtggagactccttgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccatggcttccaaggtgtacgaccccgagcaacgcaaacgcatgatcactgggcctcagtggtgggctcgctgcaagcaaatgaacgtgctggactccttcatcaactactatgattccgagaagcacgccgagaacgccgtgatttttctgcatggtaacgctgcctccagctacctgtggaggcacgtcgtgcctcacatcgagcccgtggctagatgcatcatccctgatctgatcggaatgggtaagtccggcaagagcgggaatggctcatatcgcctcctggatcactacaagtacctcaccgcttggttcgagctgctgaaccttccaaagaaaatcatctttgtgggccacgactggggggcttgtctggcctttcactactcctacgagcaccaagacaagatcaaggccatcgtccatgctgagagtgtcgtggacgtgatcgagtcctgggacgagtggcctgacatcgaggaggatatcgccctgatcaagagcgaagagggcgagaaaatggtgcttgagaataacttcttcgtcgagaccatgctcccaagcaagatcatgcggaaactggagcctgaggagttcgctgcctacctggagccattcaaggagaagggcgaggttagacggcctaccctctcctggcctcgcgagatccctctcgttaagggaggcaagcccgacgtcgtccagattgtccgcaactacaacgcctaccttcgggccagcgacgatctgcctaagatgttcatcgagtccgaccctgggttcttttccaacgctattgtcgagggagctaagaagttccctaacaccgagttcgtgaaggtgaagggcctccacttcagccaggaggacgctccagatgaaatgggtaagtacatcaagagcttcgtggagcgcgtgctgaagaacgagcagctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 86 - DNA, 10482 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacgaatcctaaacctcaaagaaaaaccaaaagaaacaccaaccgccgcccacaggacgtcaagttcccgggcggtggtcagatcgttggtggagtttacttgttgccgcgcaggggccctaggttgggtgtgcgcgcaactcggaagacttcagaacggtcgcaaccccgtggacggcgtcagcctatccccaaggcgcgccagcccacgggccggtcctggggtcaacccgggtacccttggcccctttatgccaatgagggcctcgggtgggcagggtggttgctctccccccgaggctctcggcctaattggggccccaatgacccccggcggaaatcgcgcaacttgggtaaggtcatcgataccctgacgtgcggattcgccgacctcatggggtacatcccgctcgtaggcggccccgttgggggcgtcgcaagggctctcgcacacggtgtgagggtccttgaggacggggtaaactatgcaacagggaatttacccggttgctctttctctatctttatccttgcacttctttcatgcctgactgtcccgacctctgccgttccctaccgaaatgcctctggggtttatcatgtcaccaatgattgcccaaactcttctatcgtctatgaggctgaagacctgatcttacacgcacctggttgcgtgccctgtgttaggcagggtaatgtcagtaggtgctgggtccagatcacccccacactgtcagccccgagcctcggagcggtcacggctcctcttcggagggccgttgactacttagcggggggggctgccctttgctccgcgttatacgtcggagacgcgtgcggggcagtgtttttggtaggtcaaatgttcacctatagccctcgccggcataatgttgtgcaggactgcaactgttccatttacagtggccacatcaccggccaccggatggcatgggacatgatgatgaattggtcacctacaacagctttggtgatggcccagttgttacggattccccaggtggtcattgacatcattgccggggcccactggggggtcttgttcgccgccgcatactacgcgtcggcggctaactgggccaaggttgtgctggtcctgtttctgtttgcgggggtcgatgccagcacccgcactgtgggtggtagtgcggcccaaggcgcgcgcgggctcgcttcacttttcacccctgggccgcagcagaacttgcagctcataaataccaacgggagctggcacatcaacagaactgcccttaactgtaatgacagcctccagactgggtttgtagccggcctcctgtattatcacaagttcaactccactgggtgtccgcagcggatggctagctgtaggcccctcgccgcattcgaccagggctggggaactatcagctatgccgccgtgtcgggccccagtgatgacaagccctattgctggcactaccccccacgcccgtgcggaatagtgccagcgcgaggtgtctgcggtccggtctattgttttacacctagcccggtggtcgtcggcaccacagaccgcaaggggaatcccacttacagttggggcgaaaatgagactgacatctttctcttgaacaacacgaggccccctactggcaactggtttggctgcacctggatgaattccacagggtttgtcaagacttgcggggctccaccctgcaacttagggcctacaggcaacaatagccttaagtgtcctactgattgcttccgcaagcacccagacgccacctacaccaagtgtgggtcaggaccctggctcactccccggtgtctggtgcattacccttaccggttgtggcattacccgtgcaccctaaattacaccatcttcaaggtgcgcatgtacattgggggcctcgagcacaggctcgaggtggcatgcaactggacccgtggtgagcggtgtgatcttgaagacagggatagggccgagctgagcccgctcctacataccaccacgcagtgggccatattgccgtgctctttcacacccacacccgctcttagcactggtctcatacacttacatcaaaatatagtagacacccagtatctttacggtctgagctccagcatcgtctcgtgggccgttaagtgggagtacatagtgctggccttcttattacttgctgatgcccgtatttgtacttgcctatggatcatgctcctggtttgtcaggccgaagcggccctggagaacgtcattgtcctaaacgcggctgcggctgcggggactcatgggtttttctggggcctgctcgtcatctgcttcgcctggcacttcaagggcaggttggtccctggggccacctacctttgcttgggcatttggccattactcttactccttttcctcctgccccaaagggctctagccctggactcaagcgatggcgggactgtgggttgtcttgtgttaaccatccttacaatcttcacactcacccccgggtacaagaagatggtagtgttggtcatatggtggcttcagtatttcatagcccgggtagaggcctttatccatgtgtgggtgcccccgttgcaggttaggggtggtcgtgatgctattatcatgctcacatgccttttccatcctgccctggggtttgaggtcacgaaaatcctcctcgggatactaggtcctttgtacctgctgcagtactcgctcatcaagctgccttatttcatcagggcgcgcgccctgctgagggcgtgcctgctagcgaagcacttggcctgtggcaggtacgtgcaggcggccttgctccaccttggtaggctgaccggaacgtacatttatgaccaccttgcccccatgaaggattgggcagcgtccgggctgcgcgacttagcagtggccacggagcccatcatattctcccctatggagacgaaggtcatcacgtggggggctgacacggccgcatgtggggacatacttgccggccttcctgtatcagctaggcgaggccatgaaatcttcctggggccagccgatgacatcagagaggggggctggcgacttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaggtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccatggcttccaaggtgtacgaccccgagcaacgcaaacgcatgatcactgggcctcagtggtgggctcgctgcaagcaaatgaacgtgctggactccttcatcaactactatgattccgagaagcacgccgagaacgccgtgatttttctgcatggtaacgctgcctccagctacctgtggaggcacgtcgtgcctcacatcgagcccgtggctagatgcatcatccctgatctgatcggaatgggtaagtccggcaagagcgggaatggctcatatcgcctcctggatcactacaagtacctcaccgcttggttcgagctgctgaaccttccaaagaaaatcatctttgtgggccacgactggggggcttgtctggcctttcactactcctacgagcaccaagacaagatcaaggccatcgtccatgctgagagtgtcgtggacgtgatcgagtcctgggacgagtggcctgacatcgaggaggatatcgccctgatcaagagcgaagagggcgagaaaatggtgcttgagaataacttcttcgtcgagaccatgctcccaagcaagatcatgcggaaactggagcctgaggagttcgctgcctacctggagccattcaaggagaagggcgaggttagacggcctaccctctcctggcctcgcgagatccctctcgttaagggaggcaagcccgacgtcgtccagattgtccgcaactacaacgcctaccttcgggccagcgacgatctgcctaagatgttcatcgagtccgaccctgggttcttttccaacgctattgtcgagggagctaagaagttccctaacaccgagttcgtgaaggtgaagggcctccacttcagccaggaggacgctccagatgaaatgggtaagtacatcaagagcttcgtggagcgcgtgctgaagaacgagcagctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 87 - DNA, 10497 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacacttccaaaaccccaaagaaaaaccaaaagaaacaccaaccgtcgcccaatggacgtcaagttcccgggtggcggtcagatcgttggcggagtttacttgttgccgcgcaggggcccccggttgggtgtgcgcgcgacgaggaagacttccgagcgatcccagcccagaggcaggcgccaacctataccaaaggcgcgccagccccagggcaggcactgggctcagcccggatatccttggcccctttatgggaacgagggctgtgggtgggcaggttggctcctgtccccccgcggctcccggccacactggggccccaacgacccccggcgtcgatcccggaatttgggtaaggtcatcgataccctaacgtgtgggttcgccgatctcatggggtacattcccgtcgtgggcgcgcctttgggcggcgtcgcggctgcactcgcacatggtgtgagggcaatcgaggacgggatcaattatgcaacagggaatcttcccggttgctctttctctatcttcctcttggcactactctcgtgcctcacaacgccagcgtcggctcttacctacggtaactccagtgggctataccatcttacaaatgattgccccaactccagcatcgtgctggaggcggatgccatgatcttgcatttgcctggatgcttgccttgtgtgagggtcaataacaaccagtccatctgttggcatgctgtgtcccccaccctagccataccaaatgcttccacacctgcaacgggattccgtaggcatgtggaccttcttgcgggcgccgcagtggtttgctcatccctgtacatcggggatctgtgcggctccctctttttggcagggcaactatttacctttcagccccgccgtcactggactgtgcaagactgcaactgctccatttatacaggccacgtcaccggccacaggatggcttgggacatgatgatgaattggtcacccacaaccactctggtcctatctagtatcttgagggtacctgagatctgtgcgagtgtgatatctggtggccattgggggatactactagccgttgcctactttggtatggctggcaactggctaaaagttctggctgtcctgttcttatttgcaggggttgaagcaaccaccaccatcggccatcaagtaggccgcactactggtggcttagccagtctcttctccatcggtcccaggcaaaatctacaactcatcaacaccactggcagctggcatataaacaggactgctctgaactgcaatgattccctccagacggggttcataacgtcactcttttatgccaagaacgtcaactcctcgggctgcccagagcggatggctgcgtgtaagcccctcgcggacttccggcaggggtggggccaaataacctacaaagtcaacatctcgggcccctccgacgaccgtccctactgttggcattacgctcccaggccatgtgacgtggtgtcggcccgcacggtgtgcggccccgtttactgcttcacgcccagccctgtcgtagtaggaaccactgacaagctgggcattcccacatacaactggggggagaatgagacggatgtgttcatgttggaaagccttcggcctcctactggaggatggtttgggtgcacgtggatgaactctacgggctttaccaagacctgtggtgccccgccatgtcagatagtcccgggagattacaatagctctgccaatgagcttttgtgccccaccgactgcttccgtaaacatccggaagctacatatcagcggtgtggatcgggaccctggatcacacctaggtgtctggtggattacccctacaggctgtggcactacccctgtactgtcaacttcaccttgcataaagtcaggatgttcgtgggaggcattgagcatcggtttgacgccgcatgtaactggaccagaggcgagcggtgtgatctacatgacagagacaggattgaaatgagcccgctgcttttctcaactacgcagcttgccatacttccctgttcattttccaccatgccggccttgtcaaccggcctcatccacctgcatcagaacatagtggacgtgcagtacctctacggagtctcctcgagcgttacctcgtgggtggtgaagtgggagtacattgttctggtgttcctggttctggcagatgctcggatttgtacatgtctctggttaatgctgctcataaccaacgttgaagcagcagtggaaaggcttgtcgtcctcaatgcggctagcgccgccggcaccgccggctggtggtgggcggtgctcttcctgtgctgtgcttggtacgtgaaaggccgccttgtgcctgcgtgtacctacatggcactgggaatgtggccgttgctcctgacaatcttggccctgcctcgccgagcatacgctatggacaatgagcaagcggcatccctcggagctgttggtctcttggtgctcaccatctttaccatcacccccatgtacaagaagctgttgacctgctccatttggtggaatcagtatttcctcgcccgagctgaggccatgatacacgagtgggtgcccgacctacgggttaggggcggtagggactccatcatcttacttacctgcttgttacatccacagctggggtttgaggtcaccaaaattctactagccatcctggcccctctatacatcctgcagtacagtttgctcaaggtgccttactttgtgcgcgcccacgtactcctgcgtgcttgcctgcttgttcgtaggctagcagggggtaagtacgtgcaggcgtgccttctgaggttgggcgcttggactggcacctttgtctatgaccatctcgcccctctctctgactgggctagcgacggactgcgcgatttggcagtcgcaatcgagccggtcattttctctcccatggagaagaaaatcattacctggggtgcggataccgccgcgtgtggtgacatcttgagtggcctcccggtgtcagcgaggttggggaatttggtgctactgggacccgcggacgatatgcagcgcgggggttggaagcttttggctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccatggcttccaaggtgtacgaccccgagcaacgcaaacgcatgatcactgggcctcagtggtgggctcgctgcaagcaaatgaacgtgctggactccttcatcaactactatgattccgagaagcacgccgagaacgccgtgatttttctgcatggtaacgctgcctccagctacctgtggaggcacgtcgtgcctcacatcgagcccgtggctagatgcatcatccctgatctgatcggaatgggtaagtccggcaagagcgggaatggctcatatcgcctcctggatcactacaagtacctcaccgcttggttcgagctgctgaaccttccaaagaaaatcatctttgtgggccacgactggggggcttgtctggcctttcactactcctacgagcaccaagacaagatcaaggccatcgtccatgctgagagtgtcgtggacgtgatcgagtcctgggacgagtggcctgacatcgaggaggatatcgccctgatcaagagcgaagagggcgagaaaatggtgcttgagaataacttcttcgtcgagaccatgctcccaagcaagatcatgcggaaactggagcctgaggagttcgctgcctacctggagccattcaaggagaagggcgaggttagacggcctaccctctcctggcctcgcgagatccctctcgttaagggaggcaagcccgacgtcgtccagattgtccgcaactacaacgcctaccttcgggccagcgacgatctgcctaagatgttcatcgagtccgaccctgggttcttttccaacgctattgtcgagggagctaagaagttccctaacaccgagttcgtgaaggtgaagggcctccacttcagccaggaggacgctccagatgaaatgggtaagtacatcaagagcttcgtggagcgcgtgctgaagaacgagcagctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 88 - DNA, 10491 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacgaatcctaaacctcaaagattaaccaaaagaaacaccgtccgtcgcccacagaacgttaagttcccgggtggcgggcagatcgttggcggagtctacttgttgccgcgcaggggccctagattgggtgtgcgcggcactaggaagagttcggagcgatcgcagcccaggggaagacgccaacgtatccccaaagctgcctcttcacagggtaaagcctggggcaagcccgggtacccttggcccctgtatggtaacgagggctgtggctgggcagggtggctcctgtccccccgcggctctcgacctacttggggccccactgacccccggcaccgctcgcgaaacctcggtaaggtgatcgacaccatgacctgcgggtttgccgacctcatggggtacatccctgtcctaggcgcccccctagggggcgttgccagggctctggcacatggtgttagagttctggaggacggggtcaactatgcaacagggaacttgcctggttgctccttttctatcttcttactagccctcctgtcatgtctaacagtcccggcatcggcttatgaagtccgcaactccagtggggtctatcatctcaccaatgactgccccaacgctagtatagtctatgaaacagacaacgccatcctacacgagcctgggtgcgtgccttgcgttcgcgagggtaatactagcaggtgttgggaaccagtggcccccactttggcggtccgctatcgcggagcgcttactgacgatttgcggacgcatattgacctagtggtggcgtcagctaccctgtgctccgccttgtacgtgggggacatttgtggagccatcttcattgccagccaagctgttctctggaagcccggggggggtcggatagtgcaagattgcaattgttcgatctacccgggccacgtcaccggccacaggatggcgtgggacatgatgcagaactgggcgccggccttgtcaatggttgccgcttacgctgtgagagtgcccggtgtcatcattaccactgtagcgggcggccactggggtgtgttatttggcctcgcttactttggtatggcgggaaactgggcaaaggtaatactcatcatgctactcatgtccggcgtcgacgcggaaaccatggccgtcggggctagggccgctcacaccactggcgcccttgtcagcctgctcaatccagggcccagtcagcgcctgcagctgatcaacaccaatgggtcatggcacatcaaccggaccgctttgaactgcaatgactctttgcagacagggttcatagcggccctcttctacacacataggttcaattctagtggctgtcccgagaggatggcttcttgtaaacctctcagtgactttgaccaggggtggggcccgctgtggtacaattcaacagaaagaccttcggaccagcgaccctattgctggcactacgcgccatcgccgtgtggtattgtgccggctaaggatgtttgcggtccggtctactgctttacaccaagcccggttgtggtgggcaccacggatcgccggggggtgcccacgtatacttggggtgaaaatgagtctgatgtcttcctgctcaacagcacaaggccgccgcaaggcagttggtttgggtgctcatggatgaacacaacggggttcacgaagacctgcggaggtcctccgtgcaagatacgtccccagggtgcccagagtaacacctctctcacttgtcccacagactgcttcaggaaacatccgcgtgccacatactccgcttgcggatctggtccgtggttgacacctagatgcatggtccattacccctatagactgtggcactacccgtgtacagtcaacttcaccatacacaaagtcaggttatacatagggggtgtagaacataggctcgatgcagcgtgcaattggacgcggggtgagcgatgcgacctggaggaccgagacagggtggacatgtcccccctgctccattccactacggagctcgcaatacttccgtgttcctttgtgccgcttccggccttatctacgggactgatccacctgcaccaaaacatcgttgacgcccagtacctttatggtctttctcccgctataataagctgggccatcagatgggagtgggtagtcctcgttttcctactcctggcggacgcgcggatctgcgcctgcctttggatgatgatgcttatggcccaggctgaagccgctctggagaacttgatccacctcaacgcggccagccttgcgggaacccatggtatctggtggctccttttagtcttttgtgcctcttggcatctacgaggcagggttgtccctctggtgacgtatgggatatgcgggatgtggcccttcttcctcatgttgctgagcctccccccacgagcgtatgctctggacagggaagtgagcgcagcgttgggaacgggcatgctcgccatcatcctattagttaccttgggaccgcactacaagagacttctagcccttattctctggtgggtcacatatttccttacaaggtgtgaagcagcactccaaacgtgggtccctcctctcaaccctcgggggggcagggacggtttcatcctgtgtgtgccgctgtgctatccaggccttgtctttgacatcacaaaatggttgctggtcatgatgtgccctctctacctcctccagttgtgtttggtgaggactccatactttgtgagggcccaggccctcatcagagtgtgttctctcttcaaaacgctagctgggggacggtacgtgcaggccgcgctgctcactattggccgctggaccggcacttatatttataaccatctcgcccccctggaaacatgggccgccggcggcctacgggatttggccgttgcagtcgagcccgtgatattctcccccatggagaagaagatcatagtttggggggcggagaccactgcttgtggcgacattctttgtggcctgcctgtctcagctcggctcggcagggaagtcctgctagggcccgcggatgactacaggtccatgggatggcaactcctggctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccatggcttccaaggtgtacgaccccgagcaacgcaaacgcatgatcactgggcctcagtggtgggctcgctgcaagcaaatgaacgtgctggactccttcatcaactactatgattccgagaagcacgccgagaacgccgtgatttttctgcatggtaacgctgcctccagctacctgtggaggcacgtcgtgcctcacatcgagcccgtggctagatgcatcatccctgatctgatcggaatgggtaagtccggcaagagcgggaatggctcatatcgcctcctggatcactacaagtacctcaccgcttggttcgagctgctgaaccttccaaagaaaatcatctttgtgggccacgactggggggcttgtctggcctttcactactcctacgagcaccaagacaagatcaaggccatcgtccatgctgagagtgtcgtggacgtgatcgagtcctgggacgagtggcctgacatcgaggaggatatcgccctgatcaagagcgaagagggcgagaaaatggtgcttgagaataacttcttcgtcgagaccatgctcccaagcaagatcatgcggaaactggagcctgaggagttcgctgcctacctggagccattcaaggagaagggcgaggttagacggcctaccctctcctggcctcgcgagatccctctcgttaagggaggcaagcccgacgtcgtccagattgtccgcaactacaacgcctaccttcgggccagcgacgatctgcctaagatgttcatcgagtccgaccctgggttcttttccaacgctattgtcgagggagctaagaagttccctaacaccgagttcgtgaaggtgaagggcctccacttcagccaggaggacgctccagatgaaatgggtaagtacatcaagagcttcgtggagcgcgtgctgaagaacgagcagctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgtcatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 89 - protein, 3228 aa, Hepatitis C virus
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSSGLYHVTNDCPNSSIVYEAADAILHTPGCVPCVREGNASRCWVAVTPTVATRDGKLPTTQLRRHIDLLVGSATLCSALYVGDLCGSVFLVGQLFTFSPRRHWTTQDCNCSIYPGHITGHRMAWDMMMNWSPTAALVVAQLLRIPQAIMDMIAGAHWGVLAGIAYFSMVGNWAKVLVVLLLFAGVDAETHVTGGNAGRTTAGLVGLLTPGAKQNIQLINTNGSWHINSTALNCNESLNTGWLAGLFYQHKFNSSGCPERLASCRRLTDFAQGWGPISYANGSGLDERPYCWHYPPRPCGIVPAKSVCGPVYCFTPSPVVVGTTDRSGAPTYSWGANDTDVFVLNNTRPPLGNWFGCTWMNSTGFTKVCGAPPCVIGGVGNNTLLCPTDCFRKHPEATYSRCGSGPWITPRCMVDYPYRLWHYPCTINYTIFKVRMYVGGVEHRLEAACNWTRGERCDLEDRDRSELSPLLLSTTQWQVLPCSFTTLPALSTGLIHLHQNIVDVQYLYGVGSSIASWAIKWEYVVLLFLLLADARVCSCLWMMLLISQAEAALENLVILNAASLAGTHGLVSFLVFFCFAWYLKGRWVPGAAYALYGMWPLLLLLLALPQRAYALDTEVAASCGGVVLVGLMALTLSPYYKRYISWCMWWLQYFLTRVEAQLHVWVPPLNVRGGRDAVILLMCVVHPTLVFDITKLLLAIFGPLWILQASLLKVPYFVRVQGLLRICALARKIAGGHYVQMAIIKLGALTGTYVYNHLTPLRDWAHNGLRDLAVAVEPVVFSRMETKLITWGADTAACGDIINGLPVSARRGQEILLGPADGMVSKGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAALGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYKLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 90 - protein, 3228 aa, Hepatitis C virus
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTGPASAYQVRNSTGLYHVTNDCPNSSIVFEAADAILHTPGCVPCVREGNASRCWVAVTPTVATRDGKLPTTQLRRHIDLLVGSATLCSALYVGDLCGSVFLVGQLFTFSPRRHWTTQDCNCSIYPGHISGHRMAWDMMMNWSPTAALLVAQLLRIPQAILDMIAGAHWGVLAGMAYFSMVGNWAKVLVVLLLFAGVDAETYVTGGSAARTTAGLASLFSPGAKQNIQLVNTNGSWHINSTALNCNDSLNTGWIAGLFYHHKFNSSGCSERLASCRPLTDFAQGWGPISHADGSGPDQRPYCWHYPPKPCGIVPAKSVCGPVYCFTPSPVVVGTTDRSGAPTYSWGANDTDVFVLNNTRPPLGNWFGCTWMNSTGFTKVCGAPPCVIGGVGNNTLRCPTDCFRKHPEATYSRCGSGPWITPRCLVDYPYRLWHYPCTINYTVFKVRMYVGGVEHRLEAACNWTRGDRCNLDDRDRSELSPLLLSTTQWQVLPCSFTTLPALSTGLIHLHQNIVDVQYLYGVGSSIASWAIKWEYVVLLFLLLADARVCSCLWMMLLISQVEAALENLVVLNAASLAGTHGLVSFLVFFCFAWYLKGKWVPGAAYALYGMWPLLLLLLALPQRAYALDTEVAASCGGVVLVGLMALTLSPYYKRYISWCLWWLQYFLTRIEAQLHVWIPPLNVRGGRDAVILLMCVVHPALVFDITKLLLAAFGPLWILQASLLKVPYFVRVQGLLRICALARKMAGGHYVQMAIIKLGALTGTYVYNHLTPLRDWAHNGLRDLAVAVEPVVFSRMETKLITWGADTAACGDIINGLPVSARRGREILLGPADGMVSKGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAALGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYKLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 91 - protein, 3228 aa, Hepatitis C virus
MSTNPKPQRKTKRNTNRRPQDVKFPGGGQIVGGVYLLPRRGPRLGVRATRKASERSQPRGRRQPIPKARRPEGRAWAQPGYPWPLYGNEGLGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTIPASAYEVRNVSGIYHVTNDCSNSSIVYEAADVIMHTPGCVPCVQEGNSSRCWVALTPTLAARNASVPTTTIRRHVDLLVGTAAFCSAMYVGDLCGSIFLVSQLFTFSPRRHETVQDCNCSIYPGHVSGHRMAWDMMMNWSPTTALVVSQLLRIPQAVVDMVAGAHWGVLAGLAYYSMVGNWAKVLIVALLFAGVDGETHTTGRVAGHTTSGFTSLFSSGASQKIQLVNTNGSWHINRTALNCNDSLQTGFFAALFYAHKFNSSGCPERMASCRPIDWFAQGWGPITYTKPNSSDQRPYCWHYAPRPCGVVPASQVCGPVYCFTPSPVVVGTTDRSGVPTYSWGENETDVMLLNNTRPPQGNWFGCTWMNSTGFTKTCGGPPCNIGGVGNRTLICPTDCFRKHPEATYTKCGSGPWLTPRCLVDYPYRLWHYPCTLNFSIFKVRMYVGGVEHRLNAACNWTRGERCNLEDRDRSELSPLLLSTTEWQILPCAFTTLPALSTGLIHLHQNIVDVQYLYGVGSAFVSFAIKWEYILLLFLLLADARVCACLWMMLLIAQAEAALENLVVLNAASVAGAHGILSFLVFFCAAWYIKGRLAPGAAYAFYGVWPLLLLLLALPPRAYALDREMAASCGGAVLVGLVFLTLSPYYKVFLTRLIWWLQYFITRAEAHMQVWVPPLNVRGGRDAIILLTCAVHPELILDITKLLLAILGPLMVLQAGITRVPYFVRAQGLIRACMLVRKVAGGHYVQMVFMKLGALTGTYVYNHLTPLRDWAHAGLRDLAVAVEPVVFSAMETKVITWGADTAACGDIILGLPVSARRGKEIFLGPADSLEGQGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRLGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYKLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 92 - protein, 3234 aa, Hepatitis C virus
MSTLPKPQRKTKRNTIRRPQDVKFPGGGQIVGGVYVLPRRGPRLGVRATRKTSERSQPRGRRQPIPKARRSEGRSWAQPGYPWPLYGNEGCGWAGWLLSPRGSRPSWGPNDPRRRSRNLGKVIDTLTCGFADLMGYIPLVGAPVGGVARALAHGVRALEDGINFATGNLPGCSFSIFLLALFSCLVHPAASLEWRNTSGLYVLTNDCSNSSIVYEADDVILHTPGCVPCVQDDNTSTCWTPVTPTVAVRYVGATTASIRSHVDLLVGAATLCSALYVGDMCGAVFLVGQAFTFRPRRHQTVQTCNCSLYPGHVSGHRMAWDMMMNWSPAVGMVVAHILRLPQTLFDILAGAHWGILAGLAYYSMQGNWAKVAIVMIMFSGVDAETYVTGGSVAHSARGLTSLFSMGAKQKLQLVNTNGSWHINSTALNCNESINTGFIAGLFYYHKFNSTGCPQRLSSCKPIISFRQGWGPLTDANITGPSDDRPYCWHYAPRPCSVVPASSVCGPVYCFTPSPVVVGTTDIKGKPTYNWGENETDVFLLESLRPPSGRWFGCAWMNSTGFLKTCGAPPCNIYGGEGDPENETDLFCPTDCFRKHPEATYSRCGAGPWLTPRCMVDYPYRLWHYPCTVNFTLFKVRMFVGGFEHRFTAACNWTRGERCNIEDRDRSEQHPLLHSTTELAILPCSFTPMPALSTGLIHLHQNIVDVQYLYGVGSDMVGWALKWEFVILVFLLLADARVCVALWLMLMVSQAEAALENLVTLNAVAAAGTHGIGWYLVAFCAAWYVRGKLVPLTSYGLTGLWSLALLVLLLPQRAYAWSGEDSATLGAGVLALFGFFTLSPWYKHWIGRLMWWNQYTICRCEAALQVWVPPLLARGSRDGVILLTSLLYPSLIFDITKLLIAVIGPLYLIQAAITTTPYFVRAHVLVRLCMLVRSVMGGKYFQMAILSIGRWFNTYLYDHLAPMQHWAAAGLKDLAVATEPVIFSPMEIKVITWGADTAACGDILCGLPVSARLGREVLLGPADDYREMGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKQKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYKLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 93 - protein, 3234 aa, Hepatitis C virus
MSTLPKPQRKTKRNTIRRPQDVKFPGGGQIVGGVYVLPRRGPRLGVRATRKTSERSQPRGRRQPIPKARRSEGRSWAQPGYPWPLYGNEGCGWAGWLLSPRGSRPSWGPNDPRRRSRNLGKVIDTLTCGFADLMGYIPLVGAPVGGVARALAHGVRALEDGINFATGNLPGCSFSIFLLALFSCLVHPAASLEWRNTSGLYVLTNDCSNSSIVYEADDVILHTPGCVPCVQDDNTSTCWTPVTPTVAVRYVGATTASIRSHVDLLVGAATLCSALYVGDMCGAVFLVGQAFTFRPRRHQTVQTCNCSLYPGHVSGHRMAWDMMMNWSPAVGMVVAHILRLPQTLFDILAGAHWGILAGLAYYSMQGNWAKVAIVMIMFSGVDAETYVTGGSVAHSARGLTSLFSMGAKQKLQLVNTNGSWHINSTALNCNESINTGFIAGLFYYHKFNSTGCPQRLSSCKPIISFRQGWGPLTDANITGPSDDRPYCWHYAPRPCSVVPASSVCGPVYCFTPSPVVVGTTDIKGKPTYNWGENETDVFLLESLRPPSGRWFGCAWMNSTGFLKTCGAPPCNIYGGEGDPENETDLFCPTDCFRKHPEATYSRCGAGPWLTPRCMVDYPYRLWHYPCTVNFTLFKVRMFVGGFEHRFTAACNWTRGERCNIEDRDRSEQHPLLHSTTELAILPCSFTPMPALSTGLIHLHQNIVDVQYLYGVGSDMVGWALKWEFVILVFLLLADARVCVALWLMLMVSQAEAALENLVTLNAVAAAGTHGIGWYLVAFCAAWYVRGKLVPLTIYGLTGLWSLALLVLLLPQRAYAWSGEDSATLGAGVLALFGFFTLSPWYKHWIGRLMWWNQYTICRCEAALQVWVPPLLARGSRDGVILLTSLLYPSLIFDITKLLIAVIGPLYLIQAAITTTPYFVRAHVLVRLCMLVRSVMGGKYFQMAILSIGRWFNTYLYDHLAPMQHWAAAGLKDLAVATEPVIFSPMEIKVITWGADTAACGDILCGLPVSARLGREVLLGPADDYREMGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKQKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYKLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 94 - protein, 3228 aa, Hepatitis C virus
MSTNPKPQRKTKRNTNRRPMDVKFPGGGQIVGGVYLLPRRGPRLGVRATRKTSERSQPRGRRQPIPKARRPEGRSWAQPGYPWPLYGNEGCGWAGWLLSPRGSRPSWGPNDPRRRSRNLGKVIDTLTCGFADLMGYIPLVGAPVGGVARALAHGVRALEDGINYATGNLPGCSFSIFLLALLSCLTVPASAVNYRNVSGIYHVTNDCPNSSIVYEADHHILHLPGCVPCVREGNQSRCWVALTPTVAAPYIGAPLESLRSHVDLMVGAATVCSGLYIGDLCGGLFLVGQMFSFRPRRHWTTQDCNCSIYTGHITGHRMAWDMMMNWSPTTTLVLAQVMRIPTTLVDLLSGGHWGVLVGVAYFSMQANWAKVILVLFLFAGVDAETHVSGAAVGRSTAGLANLFSSGSKQNLQLINSNGSWHINRTALNCNDSLNTGFLASLFYTHKFNSSGCSERLACCKSLDSYGQGWGPLGVANISGSSDDRPYCWHYAPRPCGIVPASSVCGPVYCFTPSPVVVGTTDHVGVPTYTWGENETDVFLLNSTRPPHGAWFGCVWMNSTGFTKTCGAPPCEVNTNNGTWHCPTDCFRKHPETTYAKCGSGPWITPRCLIDYPYRLWHFPCTANFSVFNIRTFVGGIEHRMQAACNWTRGEVCGLEHRDRVELSPLLLTTTAWQILPCSFTTLPALSTGLIHLHQNIVDVQYLYGVGSAVVSWALKWEYVVLAFLLLADARVSACLWMMFMVSQVEAALSNLININAASAAGAQGFWYAILFICIVWHVKGRFPAAAAYAACGLWPLFLLLLMLPERAYAYDQEVAGSLGGAIVVMLAILTLSPHYKLWLARGLWWIQYFIARTEAVLHVYIPSFNVRGPRDSVIVLAVLVCPHLVFDITKYLLAILGPLHILQASLLRIPYFVRAQALVKICSLLRGVVYGKYFQMVVLKAGALTGTYIYDHLTPMSDWAATGLRDLAVALEPVVFSPMEKKVIVWGADTAACGDIIRGLPVSARLGNEILLGPADTETSKGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYKLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 95 - protein, 3229 aa, Hepatitis C virus
MSTNPKPQRKTKRNTNRRPQDVKFPGGGQIVGGVYLLPRRGPRLGVRATRKTSERSQPRGRRQPIPKARQPTGRSWGQPGYPWPLYANEGLGWAGWLLSPRGSRPNWGPNDPRRKSRNLGKVIDTLTCGFADLMGYIPLVGGPVGGVARALAHGVRVLEDGVNYATGNLPGCSFSIFILALLSCLTVPTSAVPYRNASGVYHVTNDCPNSSIVYEAEDLILHAPGCVPCVRQGNVSRCWVQITPTLSAPSLGAVTAPLRRAVDYLAGGAALCSALYVGDACGAVFLVGQMFTYSPRRHNVVQDCNCSIYSGHITGHRMAWDMMMNWSPTTALVMAQLLRIPQVVIDIIAGAHWGVLFAAAYYASAANWAKVVLVLFLFAGVDASTRTVGGSAAQGARGLASLFTPGPQQNLQLINTNGSWHINRTALNCNDSLQTGFVAGLLYYHKFNSTGCPQRMASCRPLAAFDQGWGTISYAAVSGPSDDKPYCWHYPPRPCGIVPARGVCGPVYCFTPSPVVVGTTDRKGNPTYSWGENETDIFLLNNTRPPTGNWFGCTWMNSTGFVKTCGAPPCNLGPTGNNSLKCPTDCFRKHPDATYTKCGSGPWLTPRCLVHYPYRLWHYPCTLNYTIFKVRMYIGGLEHRLEVACNWTRGERCDLEDRDRAELSPLLHTTTQWAILPCSFTPTPALSTGLIHLHQNIVDTQYLYGLSSSIVSWAVKWEYIVLAFLLLADARICTCLWIMLLVCQAEAALENVIVLNAAAAAGTHGFFWGLLVICFAWHFKGRLVPGATYLCLGIWPLLLLLFLLPQRALALDSSDGGTVGCLVLTILTIFTLTPGYKKMVVLVIWWLQYFIARVEAFIHVWVPPLQVRGGRDAIIMLTCLFHPALGFEVTKILLGILGPLYLLQYSLIKLPYFIRARALLRACLLAKHLACGRYVQAALLHLGRLTGTYIYDHLAPMKDWAASGLRDLAVATEPIIFSPMETKVITWGADTAACGDILAGLPVSARRGHEIFLGPADDIREGGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTRSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYKLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 96 - protein, 3234 aa, Hepatitis C virus
MSTLPKPQRKTKRNTNRRPMDVKFPGGGQIVGGVYLLPRRGPRLGVRATRKTSERSQPRGRRQPIPKARQPQGRHWAQPGYPWPLYGNEGCGWAGWLLSPRGSRPHWGPNDPRRRSRNLGKVIDTLTCGFADLMGYIPVVGAPLGGVAAALAHGVRAIEDGINYATGNLPGCSFSIFLLALLSCLTTPASALTYGNSSGLYHLTNDCPNSSIVLEADAMILHLPGCLPCVRVNNNQSICWHAVSPTLAIPNASTPATGFRRHVDLLAGAAVVCSSLYIGDLCGSLFLAGQLFTFQPRRHWTVQDCNCSIYTGHVTGHRMAWDMMMNWSPTTTLVLSSILRVPEICASVISGGHWGILLAVAYFGMAGNWLKVLAVLFLFAGVEATTTIGHQVGRTTGGLASLFSIGPRQNLQLINTTGSWHINRTALNCNDSLQTGFITSLFYAKNVNSSGCPERMAACKPLADFRQGWGQITYKVNISGPSDDRPYCWHYAPRPCDVVSARTVCGPVYCFTPSPVVVGTTDKLGIPTYNWGENETDVFMLESLRPPTGGWFGCTWMNSTGFTKTCGAPPCQIVPGDYNSSANELLCPTDCFRKHPEATYQRCGSGPWITPRCLVDYPYRLWHYPCTVNFTLHKVRMFVGGIEHRFDAACNWTRGERCDLHDRDRIEMSPLLFSTTQLAILPCSFSTMPALSTGLIHLHQNIVDVQYLYGVSSSVTSWVVKWEYIVLVFLVLADARICTCLWLMLLITNVEAAVERLVVLNAASAAGTAGWWWAVLFLCCAWYVKGRLVPACTYMALGMWPLLLTILALPRRAYAMDNEQAASLGAVGLLVLTIFTITPMYKKLLTCSIWWNQYFLARAEAMIHEWVPDLRVRGGRDSIILLTCLLHPQLGFEVTKILLAILAPLYILQYSLLKVPYFVRAHVLLRACLLVRRLAGGKYVQACLLRLGAWTGTFVYDHLAPLSDWASDGLRDLAVAIEPVIFSPMEKKIITWGADTAACGDILSGLPVSARLGNLVLLGPADDMQRGGWKLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYKLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 97 - protein, 3232 aa, Hepatitis C virus
MSTNPKPQRLTKRNTVRRPQNVKFPGGGQIVGGVYLLPRRGPRLGVRGTRKSSERSQPRGRRQRIPKAASSQGKAWGKPGYPWPLYGNEGCGWAGWLLSPRGSRPTWGPTDPRHRSRNLGKVIDTMTCGFADLMGYIPVLGAPLGGVARALAHGVRVLEDGVNYATGNLPGCSFSIFLLALLSCLTVPASAYEVRNSSGVYHLTNDCPNASIVYETDNAILHEPGCVPCVREGNTSRCWEPVAPTLAVRYRGALTDDLRTHIDLVVASATLCSALYVGDICGAIFIASQAVLWKPGGGRIVQDCNCSIYPGHVTGHRMAWDMMQNWAPALSMVAAYAVRVPGVIITTVAGGHWGVLFGLAYFGMAGNWAKVILIMLLMSGVDAETMAVGARAAHTTGALVSLLNPGPSQRLQLINTNGSWHINRTALNCNDSLQTGFIAALFYTHRFNSSGCPERMASCKPLSDFDQGWGPLWYNSTERPSDQRPYCWHYAPSPCGIVPAKDVCGPVYCFTPSPVVVGTTDRRGVPTYTWGENESDVFLLNSTRPPQGSWFGCSWMNTTGFTKTCGGPPCKIRPQGAQSNTSLTCPTDCFRKHPRATYSACGSGPWLTPRCMVHYPYRLWHYPCTVNFTIHKVRLYIGGVEHRLDAACNWTRGERCDLEDRDRVDMSPLLHSTTELAILPCSFVPLPALSTGLIHLHQNIVDAQYLYGLSPAIISWAIRWEWVVLVFLLLADARICACLWMMMLMAQAEAALENLIHLNAASLAGTHGIWWLLLVFCASWHLRGRVVPLVTYGICGMWPFFLMLLSLPPRAYALDREVSAALGTGMLAIILLVTLGPHYKRLLALILWWVTYFLTRCEAALQTWVPPLNPRGGRDGFILCVPLCYPGLVFDITKWLLVMMCPLYLLQLCLVRTPYFVRAQALIRVCSLFKTLAGGRYVQAALLTIGRWTGTYIYNHLAPLETWAAGGLRDLAVAVEPVIFSPMEKKIIVWGAETTACGDILCGLPVSARLGREVLLGPADDYRSMGWQLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYKLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTVIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 98 - protein, 3229 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYKLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 99 - protein, 3218 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPMDSTENVIKPFMRFKVHMEGSVNGHEFEIEGEGEGKPYEGTQTAKLQVTKGGPLPFAWDILSPQFQYGSKVYVKHPADIPDYKKLSFPEGFKWERVMNFEDGGVVTVTQDSSLQDGTFIYHVKFIGVNFPSDGPVMQKKTLGWEPSTERLYPRDGVLKGEIHKALKLKGGGHYLVEFKSIYMAKKPVKLPGYYYVDSKLDITSHNEDYTVVEQYERAEARHHLFQLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 100 - protein, 3300 aa, Hepatitis C virus
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSSGLYHVTNDCPNSSIVYEAADAILHTPGCVPCVREGNASRCWVAVTPTVATRDGKLPTTQLRRHIDLLVGSATLCSALYVGDLCGSVFLVGQLFTFSPRRHWTTQDCNCSIYPGHITGHRMAWDMMMNWSPTAALVVAQLLRIPQAIMDMIAGAHWGVLAGIAYFSMVGNWAKVLVVLLLFAGVDAETHVTGGNAGRTTAGLVGLLTPGAKQNIQLINTNGSWHINSTALNCNESLNTGWLAGLFYQHKFNSSGCPERLASCRRLTDFAQGWGPISYANGSGLDERPYCWHYPPRPCGIVPAKSVCGPVYCFTPSPVVVGTTDRSGAPTYSWGANDTDVFVLNNTRPPLGNWFGCTWMNSTGFTKVCGAPPCVIGGVGNNTLLCPTDCFRKHPEATYSRCGSGPWITPRCMVDYPYRLWHYPCTINYTIFKVRMYVGGVEHRLEAACNWTRGERCDLEDRDRSELSPLLLSTTQWQVLPCSFTTLPALSTGLIHLHQNIVDVQYLYGVGSSIASWAIKWEYVVLLFLLLADARVCSCLWMMLLISQAEAALENLVILNAASLAGTHGLVSFLVFFCFAWYLKGRWVPGAAYALYGMWPLLLLLLALPQRAYALDTEVAASCGGVVLVGLMALTLSPYYKRYISWCMWWLQYFLTRVEAQLHVWVPPLNVRGGRDAVILLMCVVHPTLVFDITKLLLAIFGPLWILQASLLKVPYFVRVQGLLRICALARKIAGGHYVQMAIIKLGALTGTYVYNHLTPLRDWAHNGLRDLAVAVEPVVFSRMETKLITWGADTAACGDIINGLPVSARRGQEILLGPADGMVSKGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAALGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPMASKVYDPEQRKRMITGPQWWARCKQMNVLDSFINYYDSEKHAENAVIFLHGNAASSYLWRHVVPHIEPVARCIIPDLIGMGKSGKSGNGSYRLLDHYKYLTAWFELLNLPKKIIFVGHDWGACLAFHYSYEHQDKIKAIVHAESVVDVIESWDEWPDIEEDIALIKSEEGEKMVLENNFFVETMLPSKIMRKLEPEEFAAYLEPFKEKGEVRRPTLSWPREIPLVKGGKPDVVQIVRNYNAYLRASDDLPKMFIESDPGFFSNAIVEGAKKFPNTEFVKVKGLHFSQEDAPDEMGKYIKSFVERVLKNEQLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 101 - protein, 3300 aa, Hepatitis C virus
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTGPASAYQVRNSTGLYHVTNDCPNSSIVFEAADAILHTPGCVPCVREGNASRCWVAVTPTVATRDGKLPTTQLRRHIDLLVGSATLCSALYVGDLCGSVFLVGQLFTFSPRRHWTTQDCNCSIYPGHISGHRMAWDMMMNWSPTAALLVAQLLRIPQAILDMIAGAHWGVLAGMAYFSMVGNWAKVLVVLLLFAGVDAETYVTGGSAARTTAGLASLFSPGAKQNIQLVNTNGSWHINSTALNCNDSLNTGWIAGLFYHHKFNSSGCSERLASCRPLTDFAQGWGPISHADGSGPDQRPYCWHYPPKPCGIVPAKSVCGPVYCFTPSPVVVGTTDRSGAPTYSWGANDTDVFVLNNTRPPLGNWFGCTWMNSTGFTKVCGAPPCVIGGVGNNTLRCPTDCFRKHPEATYSRCGSGPWITPRCLVDYPYRLWHYPCTINYTVFKVRMYVGGVEHRLEAACNWTRGDRCNLDDRDRSELSPLLLSTTQWQVLPCSFTTLPALSTGLIHLHQNIVDVQYLYGVGSSIASWAIKWEYVVLLFLLLADARVCSCLWMMLLISQVEAALENLVVLNAASLAGTHGLVSFLVFFCFAWYLKGKWVPGAAYALYGMWPLLLLLLALPQRAYALDTEVAASCGGVVLVGLMALTLSPYYKRYISWCLWWLQYFLTRIEAQLHVWIPPLNVRGGRDAVILLMCVVHPALVFDITKLLLAAFGPLWILQASLLKVPYFVRVQGLLRICALARKMAGGHYVQMAIIKLGALTGTYVYNHLTPLRDWAHNGLRDLAVAVEPVVFSRMETKLITWGADTAACGDIINGLPVSARRGREILLGPADGMVSKGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAALGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPMASKVYDPEQRKRMITGPQWWARCKQMNVLDSFINYYDSEKHAENAVIFLHGNAASSYLWRHVVPHIEPVARCIIPDLIGMGKSGKSGNGSYRLLDHYKYLTAWFELLNLPKKIIFVGHDWGACLAFHYSYEHQDKIKAIVHAESVVDVIESWDEWPDIEEDIALIKSEEGEKMVLENNFFVETMLPSKIMRKLEPEEFAAYLEPFKEKGEVRRPTLSWPREIPLVKGGKPDVVQIVRNYNAYLRASDDLPKMFIESDPGFFSNAIVEGAKKFPNTEFVKVKGLHFSQEDAPDEMGKYIKSFVERVLKNEQLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 102 - protein, 3300 aa, Hepatitis C virus
MSTNPKPQRKTKRNTNRRPQDVKFPGGGQIVGGVYLLPRRGPRLGVRATRKASERSQPRGRRQPIPKARRPEGRAWAQPGYPWPLYGNEGLGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTIPASAYEVRNVSGIYHVTNDCSNSSIVYEAADVIMHTPGCVPCVQEGNSSRCWVALTPTLAARNASVPTTTIRRHVDLLVGTAAFCSAMYVGDLCGSIFLVSQLFTFSPRRHETVQDCNCSIYPGHVSGHRMAWDMMMNWSPTTALVVSQLLRIPQAVVDMVAGAHWGVLAGLAYYSMVGNWAKVLIVALLFAGVDGETHTTGRVAGHTTSGFTSLFSSGASQKIQLVNTNGSWHINRTALNCNDSLQTGFFAALFYAHKFNSSGCPERMASCRPIDWFAQGWGPITYTKPNSSDQRPYCWHYAPRPCGVVPASQVCGPVYCFTPSPVVVGTTDRSGVPTYSWGENETDVMLLNNTRPPQGNWFGCTWMNSTGFTKTCGGPPCNIGGVGNRTLICPTDCFRKHPEATYTKCGSGPWLTPRCLVDYPYRLWHYPCTLNFSIFKVRMYVGGVEHRLNAACNWTRGERCNLEDRDRSELSPLLLSTTEWQILPCAFTTLPALSTGLIHLHQNIVDVQYLYGVGSAFVSFAIKWEYILLLFLLLADARVCACLWMMLLIAQAEAALENLVVLNAASVAGAHGILSFLVFFCAAWYIKGRLAPGAAYAFYGVWPLLLLLLALPPRAYALDREMAASCGGAVLVGLVFLTLSPYYKVFLTRLIWWLQYFITRAEAHMQVWVPPLNVRGGRDAIILLTCAVHPELILDITKLLLAILGPLMVLQAGITRVPYFVRAQGLIRACMLVRKVAGGHYVQMVFMKLGALTGTYVYNHLTPLRDWAHAGLRDLAVAVEPVVFSAMETKVITWGADTAACGDIILGLPVSARRGKEIFLGPADSLEGQGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRLGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPMASKVYDPEQRKRMITGPQWWARCKQMNVLDSFINYYDSEKHAENAVIFLHGNAASSYLWRHVVPHIEPVARCIIPDLIGMGKSGKSGNGSYRLLDHYKYLTAWFELLNLPKKIIFVGHDWGACLAFHYSYEHQDKIKAIVHAESVVDVIESWDEWPDIEEDIALIKSEEGEKMVLENNFFVETMLPSKIMRKLEPEEFAAYLEPFKEKGEVRRPTLSWPREIPLVKGGKPDVVQIVRNYNAYLRASDDLPKMFIESDPGFFSNAIVEGAKKFPNTEFVKVKGLHFSQEDAPDEMGKYIKSFVERVLKNEQLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 103 - protein, 3304 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGCGWAGWLLSPRGSRPTWGPTDPRHRSRNLGRVIDTITCGFADLMGYIPVVGAPVGGVARALAHGVRVLEDGINYATGNLPGCSFSIFLLALLSCVTVPVSAVEVRNISSSYYATNDCSNNSITWQLTDAVLHLPGCVPCENDNGTLHCWIQVTPNVAVKHRGALTRSLRTHVDMIVMAATACSALYVGDVCGAVMILSQAFMVSPQRHNFTQECNCSIYQGHITGHRMAWDMMLNWSPTLAMILAYAARVPEMVLEIIFGGHWGVVFGLAYFSMQGAWAKVIAILLLVAGVDATTYSSGQEAGRTVLGFTNLFTSGAKQNLYLINTNGSWHINRTALNCNDSLQTGFMASLFYTHRFNSSGCPERLSSCRGLDDFRIGWGTLEYETHVTNDEDMRPYCWHYPPRPCGIVPARTVCGPVYCFTPSPVVVGTTDKQGVPTYTWGENETDVFLLNSTRPPRGAWFGCTWMNGTGFTKTCGAPPCRIRKDYNSTIDLLCPTDCFRKHPDATYLKCGAGPWLTPRCLVDYPYRLWHYPCTVNFTIFKARMYVGGVEHRFSAACNFTRGDRCRLEDRDRGQQSPLLHSTTEWAVLPCSFSDLPALSTGLLHLHQNIVDVQYLYGLSPALTRYIVKWEWVILLFLLLADARICACLWMLIILGQAEAALEKLIILHSASAASANGPLWFFIFFTAAWYLKGRVVPVATYSVLGLWSFLLLVLALPQQAYALDAAEQGELGLAILVIISIFTLTPAYKILLSRSVWWLSYMLVLAEAQIQQWVPPLEVRGGRDGIIWVAVILHPRLVFEVTKWLLAILGPAYLLKASLLRIPYFVRAHALLRVCTLVKHLAGARYIQMLLITIGRWTGTYIYDHLSPLSTWAAQGLRDLAIAVEPVVFSPMEKKVIVWGAETVACGDILHGLPVSARLGREVLLGPADGYTSKGWKLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPMASKVYDPEQRKRMITGPQWWARCKQMNVLDSFINYYDSEKHAENAVIFLHGNAASSYLWRHVVPHIEPVARCIIPDLIGMGKSGKSGNGSYRLLDHYKYLTAWFELLNLPKKIIFVGHDWGACLAFHYSYEHQDKIKAIVHAESVVDVIESWDEWPDIEEDIALIKSEEGEKMVLENNFFVETMLPSKIMRKLEPEEFAAYLEPFKEKGEVRRPTLSWPREIPLVKGGKPDVVQIVRNYNAYLRASDDLPKMFIESDPGFFSNAIVEGAKKFPNTEFVKVKGLHFSQEDAPDEMGKYIKSFVERVLKNEQLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 104 - protein, 3306 aa, Hepatitis C virus
MSTLPKPQRKTKRNTIRRPQDVKFPGGGQIVGGVYVLPRRGPRLGVRATRKTSERSQPRGRRQPIPKARRSEGRSWAQPGYPWPLYGNEGCGWAGWLLSPRGSRPSWGPNDPRRRSRNLGKVIDTLTCGFADLMGYIPLVGAPVGGVARALAHGVRALEDGINFATGNLPGCSFSIFLLALFSCLVHPAASLEWRNTSGLYVLTNDCSNSSIVYEADDVILHTPGCVPCVQDDNTSTCWTPVTPTVAVRYVGATTASIRSHVDLLVGAATLCSALYVGDMCGAVFLVGQAFTFRPRRHQTVQTCNCSLYPGHVSGHRMAWDMMMNWSPAVGMVVAHILRLPQTLFDILAGAHWGILAGLAYYSMQGNWAKVAIVMIMFSGVDAETYVTGGSVAHSARGLTSLFSMGAKQKLQLVNTNGSWHINSTALNCNESINTGFIAGLFYYHKFNSTGCPQRLSSCKPIISFRQGWGPLTDANITGPSDDRPYCWHYAPRPCSVVPASSVCGPVYCFTPSPVVVGTTDIKGKPTYNWGENETDVFLLESLRPPSGRWFGCAWMNSTGFLKTCGAPPCNIYGGEGDPENETDLFCPTDCFRKHPEATYSRCGAGPWLTPRCMVDYPYRLWHYPCTVNFTLFKVRMFVGGFEHRFTAACNWTRGERCNIEDRDRSEQHPLLHSTTELAILPCSFTPMPALSTGLIHLHQNIVDVQYLYGVGSDMVGWALKWEFVILVFLLLADARVCVALWLMLMVSQAEAALENLVTLNAVAAAGTHGIGWYLVAFCAAWYVRGKLVPLTSYGLTGLWSLALLVLLLPQRAYAWSGEDSATLGAGVLALFGFFTLSPWYKHWIGRLMWWNQYTICRCEAALQVWVPPLLARGSRDGVILLTSLLYPSLIFDITKLLIAVIGPLYLIQAAITTTPYFVRAHVLVRLCMLVRSVMGGKYFQMAILSIGRWFNTYLYDHLAPMQHWAAAGLKDLAVATEPVIFSPMEIKVITWGADTAACGDILCGLPVSARLGREVLLGPADDYREMGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKQKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPMASKVYDPEQRKRMITGPQWWARCKQMNVLDSFINYYDSEKHAENAVIFLHGNAASSYLWRHVVPHIEPVARCIIPDLIGMGKSGKSGNGSYRLLDHYKYLTAWFELLNLPKKIIFVGHDWGACLAFHYSYEHQDKIKAIVHAESVVDVIESWDEWPDIEEDIALIKSEEGEKMVLENNFFVETMLPSKIMRKLEPEEFAAYLEPFKEKGEVRRPTLSWPREIPLVKGGKPDVVQIVRNYNAYLRASDDLPKMFIESDPGFFSNAIVEGAKKFPNTEFVKVKGLHFSQEDAPDEMGKYIKSFVERVLKNEQLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 105 - protein, 3300 aa, Hepatitis C virus
MSTNPKPQRKTKRNTNRRPMDVKFPGGGQIVGGVYLLPRRGPRLGVRATRKTSERSQPRGRRQPIPKARRPEGRSWAQPGYPWPLYGNEGCGWAGWLLSPRGSRPSWGPNDPRRRSRNLGKVIDTLTCGFADLMGYIPLVGAPVGGVARALAHGVRALEDGINYATGNLPGCSFSIFLLALLSCLTVPASAVNYRNVSGIYHVTNDCPNSSIVYEADHHILHLPGCVPCVREGNQSRCWVALTPTVAAPYIGAPLESLRSHVDLMVGAATVCSGLYIGDLCGGLFLVGQMFSFRPRRHWTTQDCNCSIYTGHITGHRMAWDMMMNWSPTTTLVLAQVMRIPTTLVDLLSGGHWGVLVGVAYFSMQANWAKVILVLFLFAGVDAETHVSGAAVGRSTAGLANLFSSGSKQNLQLINSNGSWHINRTALNCNDSLNTGFLASLFYTHKFNSSGCSERLACCKSLDSYGQGWGPLGVANISGSSDDRPYCWHYAPRPCGIVPASSVCGPVYCFTPSPVVVGTTDHVGVPTYTWGENETDVFLLNSTRPPHGAWFGCVWMNSTGFTKTCGAPPCEVNTNNGTWHCPTDCFRKHPETTYAKCGSGPWITPRCLIDYPYRLWHFPCTANFSVFNIRTFVGGIEHRMQAACNWTRGEVCGLEHRDRVELSPLLLTTTAWQILPCSFTTLPALSTGLIHLHQNIVDVQYLYGVGSAVVSWALKWEYVVLAFLLLADARVSACLWMMFMVSQVEAALSNLININAASAAGAQGFWYAILFICIVWHVKGRFPAAAAYAACGLWPLFLLLLMLPERAYAYDQEVAGSLGGAIVVMLAILTLSPHYKLWLARGLWWIQYFIARTEAVLHVYIPSFNVRGPRDSVIVLAVLVCPHLVFDITKYLLAILGPLHILQASLLRIPYFVRAQALVKICSLLRGVVYGKYFQMVVLKAGALTGTYIYDHLTPMSDWAATGLRDLAVALEPVVFSPMEKKVIVWGADTAACGDIIRGLPVSARLGNEILLGPADTETSKGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPMASKVYDPEQRKRMITGPQWWARCKQMNVLDSFINYYDSEKHAENAVIFLHGNAASSYLWRHVVPHIEPVARCIIPDLIGMGKSGKSGNGSYRLLDHYKYLTAWFELLNLPKKIIFVGHDWGACLAFHYSYEHQDKIKAIVHAESVVDVIESWDEWPDIEEDIALIKSEEGEKMVLENNFFVETMLPSKIMRKLEPEEFAAYLEPFKEKGEVRRPTLSWPREIPLVKGGKPDVVQIVRNYNAYLRASDDLPKMFIESDPGFFSNAIVEGAKKFPNTEFVKVKGLHFSQEDAPDEMGKYIKSFVERVLKNEQLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 106 - protein, 3301 aa, Hepatitis C virus
MSTNPKPQRKTKRNTNRRPQDVKFPGGGQIVGGVYLLPRRGPRLGVRATRKTSERSQPRGRRQPIPKARQPTGRSWGQPGYPWPLYANEGLGWAGWLLSPRGSRPNWGPNDPRRKSRNLGKVIDTLTCGFADLMGYIPLVGGPVGGVARALAHGVRVLEDGVNYATGNLPGCSFSIFILALLSCLTVPTSAVPYRNASGVYHVTNDCPNSSIVYEAEDLILHAPGCVPCVRQGNVSRCWVQITPTLSAPSLGAVTAPLRRAVDYLAGGAALCSALYVGDACGAVFLVGQMFTYSPRRHNVVQDCNCSIYSGHITGHRMAWDMMMNWSPTTALVMAQLLRIPQVVIDIIAGAHWGVLFAAAYYASAANWAKVVLVLFLFAGVDASTRTVGGSAAQGARGLASLFTPGPQQNLQLINTNGSWHINRTALNCNDSLQTGFVAGLLYYHKFNSTGCPQRMASCRPLAAFDQGWGTISYAAVSGPSDDKPYCWHYPPRPCGIVPARGVCGPVYCFTPSPVVVGTTDRKGNPTYSWGENETDIFLLNNTRPPTGNWFGCTWMNSTGFVKTCGAPPCNLGPTGNNSLKCPTDCFRKHPDATYTKCGSGPWLTPRCLVHYPYRLWHYPCTLNYTIFKVRMYIGGLEHRLEVACNWTRGERCDLEDRDRAELSPLLHTTTQWAILPCSFTPTPALSTGLIHLHQNIVDTQYLYGLSSSIVSWAVKWEYIVLAFLLLADARICTCLWIMLLVCQAEAALENVIVLNAAAAAGTHGFFWGLLVICFAWHFKGRLVPGATYLCLGIWPLLLLLFLLPQRALALDSSDGGTVGCLVLTILTIFTLTPGYKKMVVLVIWWLQYFIARVEAFIHVWVPPLQVRGGRDAIIMLTCLFHPALGFEVTKILLGILGPLYLLQYSLIKLPYFIRARALLRACLLAKHLACGRYVQAALLHLGRLTGTYIYDHLAPMKDWAASGLRDLAVATEPIIFSPMETKVITWGADTAACGDILAGLPVSARRGHEIFLGPADDIREGGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTRSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPMASKVYDPEQRKRMITGPQWWARCKQMNVLDSFINYYDSEKHAENAVIFLHGNAASSYLWRHVVPHIEPVARCIIPDLIGMGKSGKSGNGSYRLLDHYKYLTAWFELLNLPKKIIFVGHDWGACLAFHYSYEHQDKIKAIVHAESVVDVIESWDEWPDIEEDIALIKSEEGEKMVLENNFFVETMLPSKIMRKLEPEEFAAYLEPFKEKGEVRRPTLSWPREIPLVKGGKPDVVQIVRNYNAYLRASDDLPKMFIESDPGFFSNAIVEGAKKFPNTEFVKVKGLHFSQEDAPDEMGKYIKSFVERVLKNEQLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 107 - protein, 3306 aa, Hepatitis C virus
MSTLPKPQRKTKRNTNRRPMDVKFPGGGQIVGGVYLLPRRGPRLGVRATRKTSERSQPRGRRQPIPKARQPQGRHWAQPGYPWPLYGNEGCGWAGWLLSPRGSRPHWGPNDPRRRSRNLGKVIDTLTCGFADLMGYIPVVGAPLGGVAAALAHGVRAIEDGINYATGNLPGCSFSIFLLALLSCLTTPASALTYGNSSGLYHLTNDCPNSSIVLEADAMILHLPGCLPCVRVNNNQSICWHAVSPTLAIPNASTPATGFRRHVDLLAGAAVVCSSLYIGDLCGSLFLAGQLFTFQPRRHWTVQDCNCSIYTGHVTGHRMAWDMMMNWSPTTTLVLSSILRVPEICASVISGGHWGILLAVAYFGMAGNWLKVLAVLFLFAGVEATTTIGHQVGRTTGGLASLFSIGPRQNLQLINTTGSWHINRTALNCNDSLQTGFITSLFYAKNVNSSGCPERMAACKPLADFRQGWGQITYKVNISGPSDDRPYCWHYAPRPCDVVSARTVCGPVYCFTPSPVVVGTTDKLGIPTYNWGENETDVFMLESLRPPTGGWFGCTWMNSTGFTKTCGAPPCQIVPGDYNSSANELLCPTDCFRKHPEATYQRCGSGPWITPRCLVDYPYRLWHYPCTVNFTLHKVRMFVGGIEHRFDAACNWTRGERCDLHDRDRIEMSPLLFSTTQLAILPCSFSTMPALSTGLIHLHQNIVDVQYLYGVSSSVTSWVVKWEYIVLVFLVLADARICTCLWLMLLITNVEAAVERLVVLNAASAAGTAGWWWAVLFLCCAWYVKGRLVPACTYMALGMWPLLLTILALPRRAYAMDNEQAASLGAVGLLVLTIFTITPMYKKLLTCSIWWNQYFLARAEAMIHEWVPDLRVRGGRDSIILLTCLLHPQLGFEVTKILLAILAPLYILQYSLLKVPYFVRAHVLLRACLLVRRLAGGKYVQACLLRLGAWTGTFVYDHLAPLSDWASDGLRDLAVAIEPVIFSPMEKKIITWGADTAACGDILSGLPVSARLGNLVLLGPADDMQRGGWKLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPMASKVYDPEQRKRMITGPQWWARCKQMNVLDSFINYYDSEKHAENAVIFLHGNAASSYLWRHVVPHIEPVARCIIPDLIGMGKSGKSGNGSYRLLDHYKYLTAWFELLNLPKKIIFVGHDWGACLAFHYSYEHQDKIKAIVHAESVVDVIESWDEWPDIEEDIALIKSEEGEKMVLENNFFVETMLPSKIMRKLEPEEFAAYLEPFKEKGEVRRPTLSWPREIPLVKGGKPDVVQIVRNYNAYLRASDDLPKMFIESDPGFFSNAIVEGAKKFPNTEFVKVKGLHFSQEDAPDEMGKYIKSFVERVLKNEQLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 108 - protein, 3304 aa, Hepatitis C virus
MSTNPKPQRLTKRNTVRRPQNVKFPGGGQIVGGVYLLPRRGPRLGVRGTRKSSERSQPRGRRQRIPKAASSQGKAWGKPGYPWPLYGNEGCGWAGWLLSPRGSRPTWGPTDPRHRSRNLGKVIDTMTCGFADLMGYIPVLGAPLGGVARALAHGVRVLEDGVNYATGNLPGCSFSIFLLALLSCLTVPASAYEVRNSSGVYHLTNDCPNASIVYETDNAILHEPGCVPCVREGNTSRCWEPVAPTLAVRYRGALTDDLRTHIDLVVASATLCSALYVGDICGAIFIASQAVLWKPGGGRIVQDCNCSIYPGHVTGHRMAWDMMQNWAPALSMVAAYAVRVPGVIITTVAGGHWGVLFGLAYFGMAGNWAKVILIMLLMSGVDAETMAVGARAAHTTGALVSLLNPGPSQRLQLINTNGSWHINRTALNCNDSLQTGFIAALFYTHRFNSSGCPERMASCKPLSDFDQGWGPLWYNSTERPSDQRPYCWHYAPSPCGIVPAKDVCGPVYCFTPSPVVVGTTDRRGVPTYTWGENESDVFLLNSTRPPQGSWFGCSWMNTTGFTKTCGGPPCKIRPQGAQSNTSLTCPTDCFRKHPRATYSACGSGPWLTPRCMVHYPYRLWHYPCTVNFTIHKVRLYIGGVEHRLDAACNWTRGERCDLEDRDRVDMSPLLHSTTELAILPCSFVPLPALSTGLIHLHQNIVDAQYLYGLSPAIISWAIRWEWVVLVFLLLADARICACLWMMMLMAQAEAALENLIHLNAASLAGTHGIWWLLLVFCASWHLRGRVVPLVTYGICGMWPFFLMLLSLPPRAYALDREVSAALGTGMLAIILLVTLGPHYKRLLALILWWVTYFLTRCEAALQTWVPPLNPRGGRDGFILCVPLCYPGLVFDITKWLLVMMCPLYLLQLCLVRTPYFVRAQALIRVCSLFKTLAGGRYVQAALLTIGRWTGTYIYNHLAPLETWAAGGLRDLAVAVEPVIFSPMEKKIIVWGAETTACGDILCGLPVSARLGREVLLGPADDYRSMGWQLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPMASKVYDPEQRKRMITGPQWWARCKQMNVLDSFINYYDSEKHAENAVIFLHGNAASSYLWRHVVPHIEPVARCIIPDLIGMGKSGKSGNGSYRLLDHYKYLTAWFELLNLPKKIIFVGHDWGACLAFHYSYEHQDKIKAIVHAESVVDVIESWDEWPDIEEDIALIKSEEGEKMVLENNFFVETMLPSKIMRKLEPEEFAAYLEPFKEKGEVRRPTLSWPREIPLVKGGKPDVVQIVRNYNAYLRASDDLPKMFIESDPGFFSNAIVEGAKKFPNTEFVKVKGLHFSQEDAPDEMGKYIKSFVERVLKNEQLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTVIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 109 - DNA, 9679 bp, Hepatitis C virus
gccagcccccgattgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacctatgacgtggacatggtcgatgccaacctgctcatggagggcggtgtggctcagacagagcctgagtccagggtgcccgttctggactttctcgagccaatggccgaggaagagagcgaccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 110 - DNA, 9679 bp, Hepatitis C virus
gcccgccccctgatgggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattaccggaaagactgggtcctttcttggataaacccactctatgtccggtcatttgggcacgcccccgcaagactgctagccgagtagcgttgggttgcgaaaggccttgtggtactgcctgatagggtgcttgcgagtgccccgggaggtctcgtagaccgtgcatcatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacctatgacgtggacatggtcgatgccaacctgctcatggagggcggtgtggctcagacagagcctgagtccagggtgcccgttctggactttctcgagccaatggccgaggaagagagcgaccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 111 - DNA, 9678 bp, Hepatitis C virus
acctgctctctatgagagcaacactccaccatgaaccgctcccctgtgaggaactactgtcttcacgcagaaagcgtctagccatggcgttagtatgagtgttgtacagcctccaggaccccccctcccgggagagccatagtggtctgcggaaccggtgagtacaccggaatcgccgggatgaccgggtcctttcttggattaacccgctcaatgcccggaaatttgggcgtgcccccgcaagactgctagccgagtagtgttgggtcgcgaaaggccttgtggtactgcctgatagggtgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacctatgacgtggacatggtcgatgccaacctgctcatggagggcggtgtggctcagacagagcctgagtccagggtgcccgttctggactttctcgagccaatggccgaggaagagagcgaccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 112 - DNA, 9677 bp, Hepatitis C virus
acccgccccttattggggcgacactccaccatgatcactcccctgtgaggaactactgtcttcacgcagaaagcgtctagccatggcgttagtatgagtgtcgaacagcctccaggaccccccctcccgggagagccatagtggtctgcggaaccggtgagtacaccggaattgccgggatgaccgggtcctttcttggataaacccgctcaatgcccggagatttgggcgtgcccccgcgagactgctagccgagtagtgttgggtcgcgaaaggccttgtggtactgcctgatagggtgcttgcgagtgccccgggaggtctcgtagaccgtgcaacatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacctatgacgtggacatggtcgatgccaacctgctcatggagggcggtgtggctcagacagagcctgagtccagggtgcccgttctggactttctcgagccaatggccgaggaagagagcgaccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 113 - DNA, 9680 bp, Hepatitis C virus
gccagccccttaacggggcgacactccgccattatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccaggatgaccgggtcctttccattggatcaaacccgctcaatgcctggagatttgggcgtgcccccgcaagactgctagccgagtagcgttgggttgcgaaaggccttgtggtactgcctgatagggtgcttgcgagtgccccgggaggtctcgtagaccgtgcatcatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacctatgacgtggacatggtcgatgccaacctgctcatggagggcggtgtggctcagacagagcctgagtccagggtgcccgttctggactttctcgagccaatggccgaggaagagagcgaccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 114 - protein, 3033 aa, Hepatitis C virus; identical to SEQ ID NO: 31

SEQ ID NO: 115 - protein, 3033 aa, Hepatitis C virus; identical to SEQ ID NO: 31

SEQ ID NO: 116 - protein, 3033 aa, Hepatitis C virus; identical to SEQ ID NO: 31

SEQ ID NO: 117 - protein, 3033 aa, Hepatitis C virus; identical to SEQ ID NO: 31

SEQ ID NO: 118 - protein, 3033 aa, Hepatitis C virus; identical to SEQ ID NO: 31

SEQ ID NO: 119 - DNA, 10263 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacgaatcctaaacctcaaagaaaaaccaaacgtaacaccaaccgtcgcccacaggacgtcaagttcccgggtggcggtcagatcgttggtggagtttacttgttgccgcgcaggggccctagattgggtgtgcgcgcgacgaggaagacttccgagcggtcgcaacctcgaggtagacgtcagcctatccccaaggcgcgtcggcccgagggcaggacctgggctcagcccgggtacccttggcccctctatggcaatgagggttgcgggtgggcgggatggctcctgtctccccgtggctctcggcctagctggggccccacggacccccggcgtaggtcgcgcaatttgggtaaggtcatcgatacccttacgtgcggcttcgccgacctcatggggtacataccgctcgtcggcgcccctcttggaggcgctgccagggccctggcgcatggcgtccgggttttggaagacggcgtgaactatgcaacagggaaccttcctggttgctctttctctattttccttctggccctgctctcttgtctgactggacccgcttcagcctaccaagtgcgcaactccacggggctttaccatgtcaccaatgattgccccaactcgagcattgtgttcgaggcggctgatgccatcctgcacactccggggtgtgtcccttgcgtacgcgagggtaacgcctcgaggtgttgggtggcggtaacccccacggtggccaccagggatggcaaactccccacaacgcagcttcgacgtcacatcgatctgcttgtcgggagcgccaccctctgctcggccctttacgtgggggacctgtgcgggtctgtctttcttgttggtcaactgttcaccttctctcccaggcgccactggacgacgcaagattgcaattgttctatctaccccggccatatttcaggtcaccgtatggcatgggatatgatgatgaactggtcccctacggcggcgttgttggtagctcagctgctccggatcccacaagccatcctggacatgatcgctggtgctcactggggagtcctggcgggcatggcgtatttctccatggtggggaactgggcgaaggttctggtagtgctgctgctatttgccggcgtcgacgcggaaacctacgtcaccgggggaagtgccgcccgtactacggctggacttgctagtcttttctcaccaggcgccaagcagaacatccagctggtcaacaccaacggcagttggcacatcaatagcacggccttgaactgcaatgacagcctcaacaccggctggatagcaggacttttctatcaccacaaattcaactcttcgggctgttccgagaggttagccagctgccgaccccttaccgattttgcccagggctggggccctatcagtcacgccgacggaagtggccccgaccaacgcccctactgctggcactaccctccaaaaccttgtggtattgtgcccgcaaagagcgtgtgtggcccggtatattgtttcactcccagtcccgtggtggtgggaacgaccgacaggtcgggcgcgcctacctacagctggggtgcaaatgacacggacgtcttcgtccttaacaacaccaggccaccgctgggcaattggttcggttgcacctggatgaactcaactggattcaccaaagtgtgcggagcgcccccttgcgtcatcggaggggtgggcaacaacaccttgcgctgccccactgattgtttccgcaagcatccggaagccacatactctcggtgcggctccggtccctggattacgcccaggtgcctggtcgactacccgtataggctttggcattatccttgtaccatcaactacaccgtgtttaaagtcaggatgtacgtgggaggggtcgagcacaggctggaagctgcctgcaactggacgcggggcgaccgttgtaatctggatgacagggacaggtccgagctcagcccgctgctgctgtccactacgcagtggcaggtcctcccgtgttccttcacgaccctgccagccttgtccaccggcctcatccacctccaccaaaacatcgtggacgtgcaatacttgtacggggtgggatcaagcatcgcgtcctgggccatcaagtgggaatacgtcgttctcttgttccttctgcttgcagacgcgcgcgtctgctcctgcttgtggatgatgttactcatatcccaagtggaggcggctttggagaacctcgtagtactcaatgcagcatccctggccgggacacacggtcttgtatccttcctcgtgttcttctgctttgcatggtatctgaagggtaagtgggtgcccggagcggtctacgccctctacgggatgtggcctctcctcttgctcctgttagcgttgccccagcgggcatacgcactggacacggaggtggccgcgtcgtgtggcggcgttgttcttgtcgggttaatggcgctgactctgtcaccatattacaagcgctatatcagctggtgcttgtggtggcttcagtatttcctgaccagaatagaagcgcaactgcacgtgtggattccccctctcaacgtccggggggggcgcgatgccgtcatcttactcatgtgtgttgtgcacccggctctggtatttgacatcaccaagctactgctggctgccttcgggcccctttggattcttcaagccagtttgcttaaggtaccctacttcgtgcgcgttcaaggccttctccggatctgcgcgctagcgcggaagatggctggaggccattacgtgcaaatggccatcatcaagttaggggcgcttactggcacttatgtttacaaccatctcaccccccttcgggactgggcgcacaacggcctgcgagatctggccgtggctgtggagccagtcgtcttctcccgaatggagaccaagcttatcacctggggggcagacaccgccgcgtgcggtgacatcatcaacggcttgcccgtctccgcccggaggggccgggagatactgctcgggccagccgatggaatggtctccaaggggtggagattgctggctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 120 - protein, 3228 aa, Hepatitis C virus
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTGPASAYQVRNSTGLYHVTNDCPNSSIVFEAADAILHTPGCVPCVREGNASRCWVAVTPTVATRDGKLPTTQLRRHIDLLVGSATLCSALYVGDLCGSVFLVGQLFTFSPRRHWTTQDCNCSIYPGHISGHRMAWDMMMNWSPTAALLVAQLLRIPQAILDMIAGAHWGVLAGMAYFSMVGNWAKVLVVLLLFAGVDAETYVTGGSAARTTAGLASLFSPGAKQNIQLVNTNGSWHINSTALNCNDSLNTGWIAGLFYHHKFNSSGCSERLASCRPLTDFAQGWGPISHADGSGPDQRPYCWHYPPKPCGIVPAKSVCGPVYCFTPSPVVVGTTDRSGAPTYSWGANDTDVFVLNNTRPPLGNWFGCTWMNSTGFTKVCGAPPCVIGGVGNNTLRCPTDCFRKHPEATYSRCGSGPWITPRCLVDYPYRLWHYPCTINYTVFKVRMYVGGVEHRLEAACNWTRGDRCNLDDRDRSELSPLLLSTTQWQVLPCSFTTLPALSTGLIHLHQNIVDVQYLYGVGSSIASWAIKWEYVVLLFLLLADARVCSCLWMMLLISQVEAALENLVVLNAASLAGTHGLVSFLVFFCFAWYLKGKWVPGAVYALYGMWPLLLLLLALPQRAYALDTEVAASCGGVVLVGLMALTLSPYYKRYISWCLWWLQYFLTRIEAQLHVWIPPLNVRGGRDAVILLMCVVHPALVFDITKLLLAAFGPLWILQASLLKVPYFVRVQGLLRICALARKMAGGHYVQMAIIKLGALTGTYVYNHLTPLRDWAHNGLRDLAVAVEPVVFSRMETKLITWGADTAACGDIINGLPVSARRGREILLGPADGMVSKGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYKLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 121 - DNA, 10479 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacgaatcctaaacctcaaagaaaaaccaaacgtaacaccaaccgtcgcccacaggacgtcaagttcccgggtggcggtcagatcgttggtggagtttacttgttgccgcgcaggggccctagattgggtgtgcgcgcgacgaggaagacttccgagcggtcgcaacctcgaggtagacgtcagcctatccccaaggcacgtcggcccgagggcaggacctgggctcagcccgggtacccttggcccctctatggcaatgagggttgcgggtgggcgggatggctcctgtctccccgtggctctcggcctagctggggccccacagacccccggcgtaggtcgcgcaatttgggtaaggtcatcgatacccttacgtgcggcttcgccgacctcatggggtacataccgctcgtcggcgcccctcttggaggcgctgccagggccctggcgcatggcgtccgggttctggaagacggcgtgaactatgcaacagggaaccttcctggttgctctttctctatcttccttctggccctgctctcttgcctgactgtgcccgcttcagcctaccaagtgcgcaattcctcggggctttaccatgtcaccaatgattgccctaactcgagtattgtgtacgaggcggccgatgccatcctgcacactccggggtgtgtcccttgcgttcgcgagggtaacgcctcgaggtgttgggtggcggtgacccccacggtggccaccagggacggcaaactccccacaacgcagcttcgacgtcatatcgatctgcttgtcgggagcgccaccctctgctcggccctctacgtgggggacctgtgcgggtctgtctttcttgttggtcaactgtttaccttctctcccaggcgccactggacgacgcaagactgcaattgttctatctatcccggccatataacgggtcatcgcatggcatgggatatgatgatgaactggtcccctacggcagcgttggtggtagctcagctgctccggatcccacaagccatcatggacatgatcgctggtgctcactggggagtcctggcgggcatagcgtatttctccatggtggggaactgggcgaaggtcctggtagtgctgctgctatttgccggcgtcgacgcggaaacccacgtcaccgggggaaatgccggccgcaccacggctgggcttgttggtctccttacaccaggcgccaagcagaacatccaactgatcaacaccaacggcagttggcacatcaatagcacggccttgaattgcaatgaaagccttaacaccggctggttagcagggctcttctatcaacacaaattcaactcttcaggctgtcctgagaggttggccagctgccgacgccttaccgattttgcccagggctggggtcctatcagttatgccaacggaagcggcctcgacgaacgcccctactgctggcactaccctccaagaccttgtggcattgtgcccgcaaagagcgtgtgtggcccggtatattgcttcactcccagccccgtggtggtgggaacgaccgacaggtcgggcgcgcctacctacagctggggtgcaaatgatacggatgtcttcgtccttaacaacaccaggccaccgctgggcaattggttcggttgtacctggatgaactcaactggattcaccaaagtgtgcggagcgcccccttgtgtcatcggaggggtgggcaacaacaccttgctctgccccactgattgcttccgcaaacatccggaagccacatactctcggtgcggctccggtccctggattacacccaggtgcatggtcgactacccgtataggctttggcactatccttgtaccatcaattacaccatattcaaagtcaggatgtacgtgggaggggtcgagcacaggctggaagcggcctgcaactggacgcggggcgaacgctgtgatctggaagacagggacaggtccgagctcagcccgttgctgctgtccaccacacagtggcaggtccttccgtgttctttcacgaccctgccagccttgtccaccggcctcatccacctccaccagaacattgtggacgtgcagtacttgtacggggtagggtcaagcatcgcgtcctgggccattaagtgggagtacgtcgttctcctgttccttctgcttgcagacgcgcgcgtctgctcctgcttgtggatgatgttactcatatcccaagcggaggcggctttggagaacctcgtaatactcaatgcagcatccctggccgggacgcacggtcttgtgtccttcctcgtgttcttctgctttgcgtggtatctgaagggtaggtgggtgcccggagcggtctacgccctctacgggatgtggcctctcctcctgctcctgctggcgttgcctcagcgggcatacgcactggacacggaggtggccgcgtcgtgtggcggcgttgttcttgtcgggttaatggcgctgactctgtcgccatattacaagcgctatatcagctggtgcatgtggtggcttcagtattttctgaccagagtagaagcgcaactgcacgtgtgggttccccccctcaacgtccggggggggcgcgatgccgtcatcttactcatgtgtgtagtacacccgaccctggtatttgacatcaccaaactactcctggccatcttcggacccctttggattcttcaagccagtttgcttaaagtcccctacttcgtgcgcgttcaaggccttctccggatctgcgcgctagcgcggaagatagccggaggtcattacgtgcaaatggccatcatcaagttaggggcgcttactggcacctatgtgtataaccatctcacccctcttcgagactgggcgcacaacggcctgcgagatctggccgtggctgtggaaccagtcgtcttctcccgaatggagaccaagctcatcacgtggggggcagataccgccgcgtgcggtgacatcatcaacggcttgcccgtctctgcccgtaggggccaggagatactgcttgggccagccgacggaatggtctccaaggggtggaggttgctggctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccatggcttccaaggtgtacgaccccgagcaacgcaaacgcatgatcactgggcctcagtggtgggctcgctgcaagcaaatgaacgtgctggactccttcatcaactactatgattccgagaagcacgccgagaacgccgtgatttttctgcatggtaacgctgcctccagctacctgtggaggcacgtcgtgcctcacatcgagcccgtggctagatgcatcatccctgatctgatcggaatgggtaagtccggcaagagcgggaatggctcatatcgcctcctggatcactacaagtacctcaccgcttggttcgagctgctgaaccttccaaagaaaatcatctttgtgggccacgactggggggcttgtctggcctttcactactcctacgagcaccaagacaagatcaaggccatcgtccatgctgagagtgtcgtggacgtgatcgagtcctgggacgagtggcctgacatcgaggaggatatcgccctgatcaagagcgaagagggcgagaaaatggtgcttgagaataacttcttcgtcgagaccatgctcccaagcaagatcatgcggaaactggagcctgaggagttcgctgcctacctggagccattcaaggagaagggcgaggttagacggcctaccctctcctggcctcgcgagatccctctcgttaagggaggcaagcccgacgtcgtccagattgtccgcaactacaacgcctaccttcgggccagcgacgatctgcctaagatgttcatcgagtccgaccctgggttcttttccaacgctattgtcgagggagctaagaagttccctaacaccgagttcgtgaaggtgaagggcctccacttcagccaggaggacgctccagatgaaatgggtaagtacatcaagagcttcgtggagcgcgtgctgaagaacgagcagctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 122 - DNA, 10479 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacgaatcctaaacctcaaagaaaaaccaaacgtaacaccaaccgtcgcccacaggacgtcaagttcccgggtggcggtcagatcgttggtggagtttacttgttgccgcgcaggggccctagattgggtgtgcgcgcgacgaggaagacttccgagcggtcgcaacctcgaggtagacgtcagcctatccccaaggcgcgtcggcccgagggcaggacctgggctcagcccgggtacccttggcccctctatggcaatgagggttgcgggtgggcgggatggctcctgtctccccgtggctctcggcctagctggggccccacggacccccggcgtaggtcgcgcaatttgggtaaggtcatcgatacccttacgtgcggcttcgccgacctcatggggtacataccgctcgtcggcgcccctcttggaggcgctgccagggccctggcgcatggcgtccgggttttggaagacggcgtgaactatgcaacagggaaccttcctggttgctctttctctattttccttctggccctgctctcttgtctgactggacccgcttcagcctaccaagtgcgcaactccacggggctttaccatgtcaccaatgattgccccaactcgagcattgtgttcgaggcggctgatgccatcctgcacactccggggtgtgtcccttgcgtacgcgagggtaacgcctcgaggtgttgggtggcggtaacccccacggtggccaccagggatggcaaactccccacaacgcagcttcgacgtcacatcgatctgcttgtcgggagcgccaccctctgctcggccctttacgtgggggacctgtgcgggtctgtctttcttgttggtcaactgttcaccttctctcccaggcgccactggacgacgcaagattgcaattgttctatctaccccggccatatttcaggtcaccgtatggcatgggatatgatgatgaactggtcccctacggcggcgttgttggtagctcagctgctccggatcccacaagccatcctggacatgatcgctggtgctcactggggagtcctggcgggcatggcgtatttctccatggtggggaactgggcgaaggttctggtagtgctgctgctatttgccggcgtcgacgcggaaacctacgtcaccgggggaagtgccgcccgtactacggctggacttgctagtcttttctcaccaggcgccaagcagaacatccagctggtcaacaccaacggcagttggcacatcaatagcacggccttgaactgcaatgacagcctcaacaccggctggatagcaggacttttctatcaccacaaattcaactcttcgggctgttccgagaggttagccagctgccgaccccttaccgattttgcccagggctggggccctatcagtcacgccgacggaagtggccccgaccaacgcccctactgctggcactaccctccaaaaccttgtggtattgtgcccgcaaagagcgtgtgtggcccggtatattgtttcactcccagtcccgtggtggtgggaacgaccgacaggtcgggcgcgcctacctacagctggggtgcaaatgacacggacgtcttcgtccttaacaacaccaggccaccgctgggcaattggttcggttgcacctggatgaactcaactggattcaccaaagtgtgcggagcgcccccttgcgtcatcggaggggtgggcaacaacaccttgcgctgccccactgattgtttccgcaagcatccggaagccacatactctcggtgcggctccggtccctggattacgcccaggtgcctggtcgactacccgtataggctttggcattatccttgtaccatcaactacaccgtgtttaaagtcaggatgtacgtgggaggggtcgagcacaggctggaagctgcctgcaactggacgcggggcgaccgttgtaatctggatgacagggacaggtccgagctcagcccgctgctgctgtccactacgcagtggcaggtcctcccgtgttccttcacgaccctgccagccttgtccaccggcctcatccacctccaccaaaacatcgtggacgtgcaatacttgtacggggtgggatcaagcatcgcgtcctgggccatcaagtgggaatacgtcgttctcttgttccttctgcttgcagacgcgcgcgtctgctcctgcttgtggatgatgttactcatatcccaagtggaggcggctttggagaacctcgtagtactcaatgcagcatccctggccgggacacacggtcttgtatccttcctcgtgttcttctgctttgcatggtatctgaagggtaagtgggtgcccggagcggtctacgccctctacgggatgtggcctctcctcttgctcctgttagcgttgccccagcgggcatacgcactggacacggaggtggccgcgtcgtgtggcggcgttgttcttgtcgggttaatggcgctgactctgtcaccatattacaagcgctatatcagctggtgcttgtggtggcttcagtatttcctgaccagaatagaagcgcaactgcacgtgtggattccccctctcaacgtccggggggggcgcgatgccgtcatcttactcatgtgtgttgtgcacccggctctggtatttgacatcaccaagctactgctggctgccttcgggcccctttggattcttcaagccagtttgcttaaggtaccctacttcgtgcgcgttcaaggccttctccggatctgcgcgctagcgcggaagatggctggaggccattacgtgcaaatggccatcatcaagttaggggcgcttactggcacttatgtttacaaccatctcaccccccttcgggactgggcgcacaacggcctgcgagatctggccgtggctgtggagccagtcgtcttctcccgaatggagaccaagcttatcacctggggggcagacaccgccgcgtgcggtgacatcatcaacggcttgcccgtctccgcccggaggggccgggagatactgctcgggccagccgatggaatggtctccaaggggtggagattgctggctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccatggcttccaaggtgtacgaccccgagcaacgcaaacgcatgatcactgggcctcagtggtgggctcgctgcaagcaaatgaacgtgctggactccttcatcaactactatgattccgagaagcacgccgagaacgccgtgatttttctgcatggtaacgctgcctccagctacctgtggaggcacgtcgtgcctcacatcgagcccgtggctagatgcatcatccctgatctgatcggaatgggtaagtccggcaagagcgggaatggctcatatcgcctcctggatcactacaagtacctcaccgcttggttcgagctgctgaaccttccaaagaaaatcatctttgtgggccacgactggggggcttgtctggcctttcactactcctacgagcaccaagacaagatcaaggccatcgtccatgctgagagtgtcgtggacgtgatcgagtcctgggacgagtggcctgacatcgaggaggatatcgccctgatcaagagcgaagagggcgagaaaatggtgcttgagaataacttcttcgtcgagaccatgctcccaagcaagatcatgcggaaactggagcctgaggagttcgctgcctacctggagccattcaaggagaagggcgaggttagacggcctaccctctcctggcctcgcgagatccctctcgttaagggaggcaagcccgacgtcgtccagattgtccgcaactacaacgcctaccttcgggccagcgacgatctgcctaagatgttcatcgagtccgaccctgggttcttttccaacgctattgtcgagggagctaagaagttccctaacaccgagttcgtgaaggtgaagggcctccacttcagccaggaggacgctccagatgaaatgggtaagtacatcaagagcttcgtggagcgcgtgctgaagaacgagcagctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 123 - DNA, 10479 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacgaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaaggcttccgagcggtcgcaacctcgtggaaggcgacaacctatcccaaaggctcgccgacccgagggcagggcctgggctcagcccgggtacccttggcccctctatggcaatgagggcctggggtgggcaggatggctcctgtcaccccgcggctcccggcctagttggggccccacggacccccggcgtaggtcgcgtaacttgggtaaggtcatcgatacccttacatgcggcttcgccgatctcatggggtacattccgctcgtcggcgcccccctagggggcgctgccagggccttggcacacggtgtccgggttctggaggacggcgtgaactatgcaacagggaacttgcccggttgctctttctctatcttcctcttggctctgctgtcctgtttgaccatcccagcttccgcttatgaagtgcgcaacgtgtccgggatataccatgtcacgaacgactgctccaactcaagcattgtgtatgaggcagcggacgtgatcatgcatactcccgggtgcgtgccctgtgttcaggagggtaacagctcccgttgctgggtagcgctcactcccacgctcgcggccaggaatgccagcgtccccactacgacaatacgacgccacgtcgacttgctcgttgggacggctgctttctgctccgctatgtacgtgggggatctctgcggatctattttcctcgtctcccagctgttcaccttctcgcctcgccggcatgagacagtgcaggactgcaactgctcaatctatcccggccatgtatcaggtcaccgcatggcttgggatatgatgatgaactggtcacctacaacagccctagtggtgtcgcagttgctccggatcccacaagctgtcgtggacatggtggcgggggcccactggggagtcctggcgggccttgcctactattccatggtagggaactgggctaaggttctgattgtggcgctactctttgccggcgttgacggggagacccacacgacggggagggtggccggccacaccacctccgggttcacgtcccttttctcatctggggcgtctcagaaaatccagcttgtgaataccaacggcagctggcacatcaacaggactgccctaaattgcaatgactccctccaaactgggttctttgccgcgctgttttacgcacacaagttcaactcgtccgggtgcccggagcgcatggccagctgccgccccattgactggttcgcccaggggtggggccccatcacctatactaagcctaacagctcggatcagaggccttattgctggcattacgcgcctcgaccgtgtggtgtcgtacccgcgtcgcaggtgtgtggtccagtgtattgtttcaccccaagccctgttgtggtggggaccaccgatcgttccggtgtccctacgtatagctggggggagaatgagacagacgtgatgctcctcaacaacacgcgtccgccacaaggcaactggttcggctgtacatggatgaatagtactgggttcactaagacgtgcggaggtcccccgtgtaacatcgggggggtcggtaaccgcaccttgatctgccccacggactgcttccggaagcaccccgaggctacttacacaaaatgtggctcggggccctggttgacacctaggtgcctagtagactacccatacaggctttggcactacccctgcactctcaatttttccatctttaaggttaggatgtatgtggggggcgtggagcacaggctcaatgccgcatgcaattggactcgaggagagcgctgtaacttggaggacagggataggtcagaactcagcccgctgctgctgtctacaacagagtggcagatactgccctgtgctttcaccaccctaccggctttatccactggtttgatccatctccatcagaacatcgtggacgtgcaatacctgtacggtgtagggtcagcgtttgtctcctttgcaatcaaatgggagtacatcctgttgcttttccttctcctggcagacgcgcgcgtgtgtgcctgcttgtggatgatgctgctgatagcccaggctgaggccgccttagagaacttggtggtcctcaatgcggcgtccgtggccggagcgcatggtattctctcctttcttgtgttcttctgcgccgcctggtacattaagggcaggctggctcctggggcggcgtatgctttttatggcgtatggccgctgctcctgctcctactggcgttaccaccacgagcttacgccttggaccgggagatggctgcatcgtgcgggggtgcggttcttgtaggtctggtattcttgaccttgtcaccatactacaaagtgtttctcactaggctcatatggtggttacaatactttatcaccagagccgaggcgcacatgcaagtgtgggtcccccccctcaacgttcggggaggccgcgatgccatcatcctcctcacgtgtgcggttcatccagagttaatttttgacatcaccaaactcctgctcgccatactcggcccgctcatggtgctccaggctggcataacgagagtgccgtacttcgtgcgcgctcaagggctcattcgtgcatgcatgttagtgcgaaaagtcgccgggggtcattatgtccaaatggtcttcatgaagctgggcgcgctgacaggtacgtacgtttataaccatcttaccccactgcgggactgggcccacgcgggcctacgagaccttgcggtggcggtagagcccgtcgtcttctccgccatggagaccaaggtcatcacctggggagcagacaccgctgcgtgtggggacatcatcttgggtctacccgtctccgcccgaagggggaaggagatatttttgggaccggctgatagtctcgaagggcaagggtggcgactccttgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccatggcttccaaggtgtacgaccccgagcaacgcaaacgcatgatcactgggcctcagtggtgggctcgctgcaagcaaatgaacgtgctggactccttcatcaactactatgattccgagaagcacgccgagaacgccgtgatttttctgcatggtaacgctgcctccagctacctgtggaggcacgtcgtgcctcacatcgagcccgtggctagatgcatcatccctgatctgatcggaatgggtaagtccggcaagagcgggaatggctcatatcgcctcctggatcactacaagtacctcaccgcttggttcgagctgctgaaccttccaaagaaaatcatctttgtgggccacgactggggggcttgtctggcctttcactactcctacgagcaccaagacaagatcaaggccatcgtccatgctgagagtgtcgtggacgtgatcgagtcctgggacgagtggcctgacatcgaggaggatatcgccctgatcaagagcgaagagggcgagaaaatggtgcttgagaataacttcttcgtcgagaccatgctcccaagcaagatcatgcggaaactggagcctgaggagttcgctgcctacctggagccattcaaggagaagggcgaggttagacggcctaccctctcctggcctcgcgagatccctctcgttaagggaggcaagcccgacgtcgtccagattgtccgcaactacaacgcctaccttcgggccagcgacgatctgcctaagatgttcatcgagtccgaccctgggttcttttccaacgctattgtcgagggagctaagaagttccctaacaccgagttcgtgaaggtgaagggcctccacttcagccaggaggacgctccagatgaaatgggtaagtacatcaagagcttcgtggagcgcgtgctgaagaacgagcagctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 124 - DNA, 10497 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacacttcctaaacctcaaagaaaaaccaaaagaaacaccatccgtcgcccacaggacgttaagttcccgggtggcggacagatcgttggtggagtatacgtgttgccgcgcaggggcccacgattgggtgtgcgcgcgacgcgtaaaacttctgaacggtcacagcctcgcggacgacgacagcctatccccaaggcgcgtcggagcgaaggccggtcctgggctcagcccgggtacccttggcccctctatggtaatgagggctgcgggtgggcagggtggctcctgtccccgcgcggctcccgtccatcttggggcccaaacgacccccggcggaggtcccgcaatttgggtaaagtcatcgatacccttacgtgcggattcgccgacctcatggggtacatcccgctcgtcggcgctcccgtaggaggcgtcgcaagagccctcgcgcatggcgtgagggcccttgaagacgggataaattttgcaacagggaacttgcccggttgctccttttctatcttccttcttgctctgttctcctgcttagttcatcctgcagctagtcttgagtggcggaatacgtctggcctctatgtccttaccaacgactgttccaatagcagtattgtgtatgaggccgatgacgtcattctgcacacacccggctgtgtaccttgtgttcaggacgacaatacatccacgtgctggaccccagtgacacctacggtggcagtcaggtacgtcggagcaaccaccgcttcgatacgcagtcatgtggacctattagtgggcgcggccacgctgtgctctgcgctctatgtgggtgatatgtgtggggccgtctttctcgtgggacaagccttcacgttcagacctcgtcgccatcaaacggtccagacctgtaactgctcgctgtacccaggccatgtttcaggacatcgaatggcttgggatatgatgatgaattggtcccccgctgtgggtatggtggtggcgcacatcctgcgattgccccagaccttgtttgacatactggccggggcccattggggcatcttggcgggcctagcctattattctatgcagggcaactgggccaaggtcgctattgtcatgattatgttttcaggggtcgatgctgaaacatatgtcaccggtggcagtgtagctcatagtgccagagggttaactagcctttttagtatgggcgccaagcagaaactgcaattggtcaacaccaatggctcgtggcacatcaacagtactgccctgaactgcaatgagtccataaacaccgggttcatagctgggttgttttattaccataagttcaactctactggatgtcctcaaaggcttagcagctgcaagcccatcatttccttcaggcaggggtggggccccttgacagatgctaacatcaccggtccttctgatgatagaccgtattgctggcactacgcacctagaccttgtagtgttgtcccggcatcaagtgtctgcggccctgtgtactgcttcacaccatcgccagtggtcgtaggcactactgatatcaaaggcaagccgacctacaactggggtgagaatgagacagatgtgttcctgctggagtccctgcggcctcccagtggccggtggtttggatgcgcgtggatgaactccacggggttcctcaagacgtgtggagctcccccttgtaacatctatgggggtgagggggatcccgaaaatgagacagacctcttctgccccaccgactgcttcaggaaacatcctgaggccacatacagccggtgtggtgcggggccctggttgacacctcgctgcatggtcgactatccataccggctttggcattacccatgtacagtcaatttcacattgttcaaggtgaggatgtttgtgggcggatttgaacaccggtttaccgccgcttgtaactggaccaggggggagcgctgcaatatcgaggatcgtgatcgcagcgagcaacatccgctgctgcattcaacaactgagcttgctatactgccttgctctttcacgcccatgcctgcattgtcaacaggtctaatacacctccaccaaaatatcgtggatgtccaatacctttatggtgttggatctgacatggtgggatgggcgctgaaatgggagttcgtcatcctcgttttcctcctcctggcagacgcacgcgtgtgcgttgccctttggctgatgctgatggtatcacaagcagaagcagccttggagaaccttgtcacgctgaacgccgtcgctgctgctgggacacatggtattggttggtacctggtagccttttgcgcggcgtggtacgtgcggggtaaacttgtcccgctgacgatctacggcctgacgggtctttggtccctagcattgcttgtcctcttgctcccccaacgggcgtatgcttggtcgggtgaagacagcgctactctcggcgctggggtcttggccctcttcggcttctttaccttatcaccctggtacaagcattggatcggccgcctcatgtggtggaaccagtacactatatgtagatgcgaggccgcccttcaagtgtgggtcccccccttacttgcacgcgggagtagggacggtgtcatcctgctaacaagcttgctttatccatccttaatttttgacatcactaagctgctgatagcagtaataggcccattatacttaatacaggctgccatcactaccaccccctactttgtgcgcgcacatgtactggtccgcctttgcatgctcgtgcgctccgtgatggggggaaagtacttccagatggccatactgagcattggcagatggttcaacacctacctatatgaccacctagcgccaatgcaacattgggccgcagctggcctcaaagacctagcagtggccactgaacctgtaatatttagtcccatggaaattaaggtcatcacctggggcgcggacacagcggcttgcggagatattctttgcgggctgccggtctccgcgcgattaggccgtgaggtattgttgggacctgctgatgattatcgggaaatgggttggcgtctgttggctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccatggcttccaaggtgtacgaccccgagcaacgcaaacgcatgatcactgggcctcagtggtgggctcgctgcaagcaaatgaacgtgctggactccttcatcaactactatgattccgagaagcacgccgagaacgccgtgatttttctgcatggtaacgctgcctccagctacctgtggaggcacgtcgtgcctcacatcgagcccgtggctagatgcatcatccctgatctgatcggaatgggtaagtccggcaagagcgggaatggctcatatcgcctcctggatcactacaagtacctcaccgcttggttcgagctgctgaaccttccaaagaaaatcatctttgtgggccacgactggggggcttgtctggcctttcactactcctacgagcaccaagacaagatcaaggccatcgtccatgctgagagtgtcgtggacgtgatcgagtcctgggacgagtggcctgacatcgaggaggatatcgccctgatcaagagcgaagagggcgagaaaatggtgcttgagaataacttcttcgtcgagaccatgctcccaagcaagatcatgcggaaactggagcctgaggagttcgctgcctacctggagccattcaaggagaagggcgaggttagacggcctaccctctcctggcctcgcgagatccctctcgttaagggaggcaagcccgacgtcgtccagattgtccgcaactacaacgcctaccttcgggccagcgacgatctgcctaagatgttcatcgagtccgaccctgggttcttttccaacgctattgtcgagggagctaagaagttccctaacaccgagttcgtgaaggtgaagggcctccacttcagccaggaggacgctccagatgaaatgggtaagtacatcaagagcttcgtggagcgcgtgctgaagaacgagcagctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 125 - DNA, 10479 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacgaatcctaaacctcaaagaaaaaccaaacgtaacaccaaccgccgcccaatggacgttaagttcccgggtggtggccagatcgttggcggagtttacttgttgccgcgcaggggccccagattgggtgtgcgcgcgactcggaagacttcggagcggtcgcaacctcgtggaagacgccaacctatccccaaggcgcgtcgacccgagggaaggtcctgggcacaaccaggatatccatggcctctttacggtaatgagggttgtgggtgggcaggatggctcttgtccccccgtggctctcgaccgtcttggggcccaaatgatccccggcggaggtcccgcaatttgggtaaggtcatcgataccctaacctgcggcttcgccgacctcatgggatacatcccgctcgtaggcgcccccgtgggtggcgtcgccagggccctggcacatggtgtcagggctttggaggacgggatcaattatgcaacagggaatctccccggttgctccttttctatcttcctcttggcacttctttcgtgcctgactgtccccgcttcggccgttaactatcgcaatgtctcgggcatctaccatgtcaccaatgactgcccgaattcaagcatagtgtatgaggccgaccatcacatcttgcaccttccaggttgcgtgccctgcgtgagagaggggaatcagtcacgctgctgggtggcccttactcctaccgtcgcagcgccatacatcggcgcaccgcttgagtccttacggagtcatgtggatttgatggtgggggccgccactgtttgctcgggtctttacatcggggacctgtgtggcggcttgttcctagttggccagatgttttcattccgaccacggcgccactggaccacccaggattgcaattgttccatctacacagggcacattacaggccacagaatggcctgggacatgatgatgaactggagtccaacaaccaccttagttctcgcccaggtcatgaggatcccaaccactctggtagacttactctctggaggccactggggtgtcctcgtgggagtggcctatttcagcatgcaggccaattgggccaaagtcatcttggtcctattcctctttgcaggggttgatgccgagactcacgtgtctggggcagcagtcggccggagtaccgccggcttggctaacctcttttcttctgggtctaagcagaatttacagctcatcaacagcaatgggagctggcatataaataggactgcccttaactgcaatgacagcttaaacactgggttcttggctagcttgttctacacccacaagtttaacagctcagggtgttccgaacggctcgcgtgctgcaagagccttgacagctacggccaaggctggggcccactcggggtcgctaacatcagcggctcgtctgatgacaggccttattgctggcactacgcgcctcggccgtgcgggattgtgccagcatccagtgtgtgtggccccgtgtattgtttcactcccagccctgtcgtggtcggtactactgatcacgtcggggtccctacttacacctggggggagaatgagactgatgtcttccttttgaactcgaccagaccgccgcatggtgcgtggtttggatgcgtgtggatgaacagtaccgggttcaccaaaacctgtggcgcccctccatgcgaggttaacaccaataatgggacctggcactgccccaccgattgcttcaggaagcatccggagactacctacgccaagtgcggatcagggccttggatcacaccgcgctgcctgattgattacccgtaccggctgtggcatttcccgtgcaccgccaacttctccgtctttaacatcaggacatttgtcggcggtatagagcatcggatgcaagcggcatgcaactggaccaggggggaagtctgtggcttggagcacagggatcgcgtagagctatcacccctgctccttaccactacagcgtggcagatcctcccctgctctttcaccactttacctgccctctccaccggcttgatccacctccaccaaaatatcgtggacgtccagtacctctatggtgttgggtctgcagtggtatcttgggcccttaagtgggaatatgtggtgctcgcgttcctgcttctcgcggacgcgagagtctctgcctgcctatggatgatgtttatggtaagtcaagttgaggcggctctgtccaacctgattaacatcaatgctgcttcagccgctggtgcccaaggcttctggtacgccatcctcttcatctgcattgtctggcatgtcaagggccggttcccagctgctgctgcctacgcagcctgcgggctgtggcccctgtttctcctgcttctgatgctgcctgagagggcttatgcatacgaccaggaagtggcagggtcccttggcggcgccatcgttgtcatgctgaccattctgacactgtctccgcactacaagttatggctggctaggggattgtggtggatccaatattttatagctaggaccgaggctgtgctgcatgtctatattccatccttcaacgtgcgcgggcctcgcgactcagtgattgttcttgcagtcctggtctgtccacacctagtatttgacatcacaaaatatcttctggccatcttagggcccctccacatactccaggcctcgctcctacgcatcccttactttgtgagggcacaagcgctggttaagatctgcagcttgttgcgtggggtagtttatggcaagtacttccaaatggtcgtgcttaaagcaggggccctgactggtacttacatctatgaccaccttactcccatgtcagattgggccgctacgggcctccgcgatttggcggtggccctagagccagttgtgttcacgcccatggagaagaaagtcatcgtctggggcgctgacaccgctgcgtgcggagacatcataaggggattacctgtttcggccaggttgggcaatgaaatcttgctcggaccagccgatacagaaacatcaaaggggtggagactccttgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccatggcttccaaggtgtacgaccccgagcaacgcaaacgcatgatcactgggcctcagtggtgggctcgctgcaagcaaatgaacgtgctggactccttcatcaactactatgattccgagaagcacgccgagaacgccgtgatttttctgcatggtaacgctgcctccagctacctgtggaggcacgtcgtgcctcacatcgagcccgtggctagatgcatcatccctgatctgatcggaatgggtaagtccggcaagagcgggaatggctcatatcgcctcctggatcactacaagtacctcaccgcttggttcgagctgctgaaccttccaaagaaaatcatctttgtgggccacgactggggggcttgtctggcctttcactactcctacgagcaccaagacaagatcaaggccatcgtccatgctgagagtgtcgtggacgtgatcgagtcctgggacgagtggcctgacatcgaggaggatatcgccctgatcaagagcgaagagggcgagaaaatggtgcttgagaataacttcttcgtcgagaccatgctcccaagcaagatcatgcggaaactggagcctgaggagttcgctgcctacctggagccattcaaggagaagggcgaggttagacggcctaccctctcctggcctcgcgagatccctctcgttaagggaggcaagcccgacgtcgtccagattgtccgcaactacaacgcctaccttcgggccagcgacgatctgcctaagatgttcatcgagtccgaccctgggttcttttccaacgctattgtcgagggagctaagaagttccctaacaccgagttcgtgaaggtgaagggcctccacttcagccaggaggacgctccagatgaaatgggtaagtacatcaagagcttcgtggagcgcgtgctgaagaacgagcagctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 126 - DNA, 10482 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacgaatcctaaacctcaaagaaaaaccaaaagaaacaccaaccgccgcccacaggacgtcaagttcccgggcggtggtcagatcgttggtggagtttacttgttgccgcgcaggggccctaggttgggtgtgcgcgcaactcggaagacttcagaacggtcgcaaccccgtggacggcgtcagcctatccccaaggcgcgccagcccacgggccggtcctggggtcaacccgggtacccttggcccctttatgccaatgagggcctcgggtgggcagggtggttgctctccccccgaggctctcggcctaattggggccccaatgacccccggcggaaatcgcgcaacttgggtaaggtcatcgataccctgacgtgcggattcgccgacctcatggggtacatcccgctcgtaggcggccccgttgggggcgtcgcaagggctctcgcacacggtgtgagggtccttgaggacggggtaaactatgcaacagggaatttacccggttgctctttctctatctttatccttgcacttctttcatgcctgactgtcccgacctctgccgttccctaccgaaatgcctctggggtttatcatgtcaccaatgattgcccaaactcttctatcgtctatgaggctgaagacctgatcttacacgcacctggttgcgtgccctgtgttaggcagggtaatgtcagtaggtgctgggtccagatcacccccacactgtcagccccgagcctcggagcggtcacggctcctcttcggagggccgttgactacttagcggggggggctgccctttgctccgcgttatacgtcggagacgcgtgcggggcagtgtttttggtaggtcaaatgttcacctatagccctcgccggcataatgttgtgcaggactgcaactgttccatttacagtggccacatcaccggccaccggatggcatgggacatgatgatgaattggtcacctacaacagctttggtgatggcccagttgttacggattccccaggtggtcattgacatcattgccggggcccactggggggtcttgttcgccgccgcatactacgcgtcggcggctaactgggccaaggttgtgctggtcctgtttctgtttgcgggggtcgatgccagcacccgcactgtgggtggtagtgcggcccaaggcgcgcgcgggctcgcttcacttttcacccctgggccgcagcagaacttgcagctcataaataccaacgggagctggcacatcaacagaactgcccttaactgtaatgacagcctccagactgggtttgtagccggcctcctgtattatcacaagttcaactccactgggtgtccgcagcggatggctagctgtaggcccctcgccgcattcgaccagggctggggaactatcagctatgccgccgtgtcgggccccagtgatgacaagccctattgctggcactaccccccacgcccgtgcggaatagtgccagcgcgaggtgtctgcggtccggtctattgttttacacctagcccggtggtcgtcggcaccacagaccgcaaggggaatcccacttacagttggggcgaaaatgagactgacatctttctcttgaacaacacgaggccccctactggcaactggtttggctgcacctggatgaattccacagggtttgtcaagacttgcggggctccaccctgcaacttagggcctacaggcaacaatagccttaagtgtcctactgattgcttccgcaagcacccagacgccacctacaccaagtgtgggtcaggaccctggctcactccccggtgtctggtgcattacccttaccggttgtggcattacccgtgcaccctaaattacaccatcttcaaggtgcgcatgtacattgggggcctcgagcacaggctcgaggtggcatgcaactggacccgtggtgagcggtgtgatcttgaagacagggatagggccgagctgagcccgctcctacataccaccacgcagtgggccatattgccgtgctctttcacacccacacccgctcttagcactggtctcatacacttacatcaaaatatagtagacacccagtatctttacggtctgagctccagcatcgtctcgtgggccgttaagtgggagtacatagtgctggccttcttattacttgctgatgcccgtatttgtacttgcctatggatcatgctcctggtttgtcaggccgaagcggccctggagaacgtcattgtcctaaacgcggctgcggctgcggggactcatgggtttttctggggcctgctcgtcatctgcttcgcctggcacttcaagggcaggttggtccctggggccacctacctttgcttgggcatttggccattactcttactccttttcctcctgccccaaagggctctagccctggactcaagcgatggcgggactgtgggttgtcttgtgttaaccatccttacaatcttcacactcacccccgggtacaagaagatggtagtgttggtcatatggtggcttcagtatttcatagcccgggtagaggcctttatccatgtgtgggtgcccccgttgcaggttaggggtggtcgtgatgctattatcatgctcacatgccttttccatcctgccctggggtttgaggtcacgaaaatcctcctcgggatactaggtcctttgtacctgctgcagtactcgctcatcaagctgccttatttcatcagggcgcgcgccctgctgagggcgtgcctgctagcgaagcacttggcctgtggcaggtacgtgcaggcggccttgctccaccttggtaggctgaccggaacgtacatttatgaccaccttgcccccatgaaggattgggcagcgtccgggctgcgcgacttagcagtggccacggagcccatcatattctcccctatggagacgaaggtcatcacgtggggggctgacacggccgcatgtggggacatacttgccggccttcctgtatcagctaggcgaggccatgaaatcttcctggggccagccgatgacatcagagaggcgggctggcgacttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccatggcttccaaggtgtacgaccccgagcaacgcaaacgcatgatcactgggcctcagtggtgggctcgctgcaagcaaatgaacgtgctggactccttcatcaactactatgattccgagaagcacgccgagaacgccgtgatttttctgcatggtaacgctgcctccagctacctgtggaggcacgtcgtgcctcacatcgagcccgtggctagatgcatcatccctgatctgatcggaatgggtaagtccggcaagagcgggaatggctcatatcgcctcctggatcactacaagtacctcaccgcttggttcgagctgctgaaccttccaaagaaaatcatctttgtgggccacgactggggggcttgtctggcctttcactactcctacgagcaccaagacaagatcaaggccatcgtccatgctgagagtgtcgtggacgtgatcgagtcctgggacgagtggcctgacatcgaggaggatatcgccctgatcaagagcgaagagggcgagaaaatggtgcttgagaataacttcttcgtcgagaccatgctcccaagcaagatcatgcggaaactggagcctgaggagttcgctgcctacctggagccattcaaggagaagggcgaggttagacggcctaccctctcctggcctcgcgagatccctctcgttaagggaggcaagcccgacgtcgtccagattgtccgcaactacaacgcctaccttcgggccagcgacgatctgcctaagatgttcatcgagtccgaccctgggttcttttccaacgctattgtcgagggagctaagaagttccctaacaccgagttcgtgaaggtgaagggcctccacttcagccaggaggacgctccagatgaaatgggtaagtacatcaagagcttcgtggagcgcgtgctgaagaacgagcagctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 127 - DNA, 10497 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacacttccaaaaccccaaagaaaaaccaaaagaaacaccaaccgtcgcccaatggacgtcaagttcccgggtggcggtcagatcgttggcggagtttacttgttgccgcgcaggggcccccggttgggtgtgcgcgcgacgaggaagacttccgagcgatcccagcccagaggcaggcgccaacctataccaaaggcgcgccagccccagggcaggcactgggctcagcccggatatccttggcccctttatgggaacgagggctgtgggtgggcaggttggctcctgtccccccgcggctcccggccacactggggccccaacgacccccggcgtcgatcccggaatttgggtaaggtcatcgataccctaacgtgtgggttcgccgatctcatggggtacattcccgtcgtgggcgcgcctttgggcggcgtcgcggctgcactcgcacatggtgtgagggcaatcgaggacgggatcaattatgcaacagggaatcttcccggttgctctttctctatcttcctcttggcactactctcgtgcctcacaacgccagcgtcggctcttacctacggtaactccagtgggctataccatcttacaaatgattgccccaactccagcatcgtgctggaggcggatgccatgatcttgcatttgcctggatgcttgccttgtgtgagggtcaataacaaccagtccatctgttggcatgctgtgtcccccaccctagccataccaaatgcttccacacctgcaacgggattccgtaggcatgtggaccttcttgcgggcgccgcagtggtttgctcatccctgtacatcggggatctgtgcggctccctctttttggcagggcaactatttacctttcagccccgccgtcactggactgtgcaagactgcaactgctccatttatacaggccacgtcaccggccacaggatggcttgggacatgatgatgaattggtcacccacaaccactctggtcctatctagtatcttgagggtacctgagatctgtgcgagtgtgatatttggtggccattgggggatactactagccgttgcctactttggtatggctggcaactggctaaaagttctggctgtcctgttcttatttgcaggggttgaagcaaccaccaccatcggccatcaagtaggccgcactactggtggcttagccagtctcttctccatcggtcccaggcaaaatctacaactcatcaacaccaatggcagctggcatataaacaggactgctctgaactgcaatgattccctccagacggggttcataacgtcactcttttatgccaagaacgtcaactcctcgggctgcccagagcggatggctgcgtgtaagcccctcgcggacttccggcaggggtggggccaaataacctacaaagtcaacatctcgggcccctccgacgaccgtccctactgttggcattacgctcccaggccatgtgacgtggtgtcggcccgcacggtgtgcggccccgtttactgcttcacgcccagccctgtcgtagtaggaaccactgacaagctgggcattcccacatacaactggggggagaatgagacggatgtgttcatgttggaaagccttcggcctcctactggaggatggtttgggtgcacgtggatgaactctacgggctttaccaagacctgtggtgccccgccatgtcagatagtcccgggagattacaatagctctgccaatgagcttttgtgccccaccgactgcttccgtaaacatccggaagctacatatcagcggtgtggatcgggaccctggatcacacctaggtgtctggtggattacccctacaggctgtggcactacccctgtactgtcaacttcaccttgcataaagtcaggatgttcgtgggaggcattgagcatcggtttgacgccgcatgtaactggaccagaggcgagcggtgtgatctacatgacagagacaggattgaaatgagcccgctgcttttctcaactacgcagcttgccatacttccctgttcattttccaccatgccggccttgtcaaccggcctcatccacctgcatcagaacatagtggacgtgcagtacctctacggagtctcctcgagcgttacctcgtgggtggtgaagtgggagtacattgttctggtgttcctggttctggcagatgctcggatttgtacatgtctctggttaatgctgctcataaccaacgttgaagcagcagtggaaaggcttgtcgtcctcaatgcggctagcgccgccggcaccgccggctggtggtgggcggtgctcttcctgtgctgtgcttggtacgtgaaaggccgccttgtgcctgcgtgtacctacatggcactgggaatgtggccgttgctcctgacaatcttggccctgcctcgccgagcatacgctatggacaatgagcaagcggcatccctcggagctgttggtctcttggtgctcaccatctttaccatcacccccatgtacaagaagctgttgacctgctccatttggtggaatcagtatttcctcgcccgagctgaggccatgatacacgagtgggtgcccgacctacgggttaggggcggtagggactccatcatcttacttacctgcttgttacatccacagctggggtttgaggtcaccaaaattctactagccatcctggcccctctatacatcctgcagtacagtttgctcaaggtgccttactttgtgcgcgcccacgtactcctgcgtgcttgcctgcttgttcgtaggctagcagggggtaagtacgtgcaggcgtgccttctgaggttgggcgcttggactggcacctttgtctatgaccatctcgcccctctctctgactgggctagcgacggactgcgcgatttggcagtcgcaatcgagccggtcattttctctcccatggagaagaaaatcattacctggggtgcggataccgccgcgtgtggtgacatcttgagtggcctcccggtgtcagcgaggttggggaatttggtgctactgggacccgcggacgatatgcagcgcgggggttggaagcttttggctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccatggcttccaaggtgtacgaccccgagcaacgcaaacgcatgatcactgggcctcagtggtgggctcgctgcaagcaaatgaacgtgctggactccttcatcaactactatgattccgagaagcacgccgagaacgccgtgatttttctgcatggtaacgctgcctccagctacctgtggaggcacgtcgtgcctcacatcgagcccgtggctagatgcatcatccctgatctgatcggaatgggtaagtccggcaagagcgggaatggctcatatcgcctcctggatcactacaagtacctcaccgcttggttcgagctgctgaaccttccaaagaaaatcatctttgtgggccacgactggggggcttgtctggcctttcactactcctacgagcaccaagacaagatcaaggccatcgtccatgctgagagtgtcgtggacgtgatcgagtcctgggacgagtggcctgacatcgaggaggatatcgccctgatcaagagcgaagagggcgagaaaatggtgcttgagaataacttcttcgtcgagaccatgctcccaagcaagatcatgcggaaactggagcctgaggagttcgctgcctacctggagccattcaaggagaagggcgaggttagacggcctaccctctcctggcctcgcgagatccctctcgttaagggaggcaagcccgacgtcgtccagattgtccgcaactacaacgcctaccttcgggccagcgacgatctgcctaagatgttcatcgagtccgaccctgggttcttttccaacgctattgtcgagggagctaagaagttccctaacaccgagttcgtgaaggtgaagggcctccacttcagccaggaggacgctccagatgaaatgggtaagtacatcaagagcttcgtggagcgcgtgctgaagaacgagcagctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 128 - DNA, 10491 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacgaatcctaaacctcaaagattaaccaaaagaaacaccgtccgtcgcccacagaacgttaagttcccgggtggcgggcagatcgttggcggagtctacttgttgccgcgcaggggccctagattgggtgtgcgcggcactaggaagagttcggagcgatcgcagcccaggggaagacgccaacgtatccccaaagctgcctcttcacagggtaaagcctggggcaagcccgggtacccttggcccctgtatggtaacgagggctgtggctgggcagggtggctcctgtccccccgcggctctcgacctacttggggccccactgacccccggcaccgctcgcgaaacctcggtaaggtgatcgacaccatgacctgcgggtttgccgacctcatggggtacatccctgtcctaggcgcccccctagggggcgttgccagggctctggcacatggtgttagagttctggaggacggggtcaactatgcaacagggaacttgcctggttgctccttttctatcttcttactagccctcctgtcatgtctaacagtcccggcatcggcttatgaagtccgcaactccagtggggtctatcatctcaccaatgactgccccaacgctagtatagtctatgaaacagacaacgccatcctacacgagcctgggtgcgtgccttgcgttcgcgagggtaatactagcaggtgttgggaaccagtggcccccactttggcggtccgctatcgcggagcgcttactgacgatttgcggacgcatattgacctagtggtggcgtcagctaccctgtgctccgccttgtacgtgggggacatttgtggagccatcttcattgccagccaagctgttctctggaagcccggggggggtcggatagtgcaagattgcaattgttcgatctacccgggccacgtcaccggccacaggatggcgtgggacatgatgcagaactgggcgccggccttgtcaatggttgccgcttacgctgtgagagtgcccggtgtcatcattaccactgtagcgggcggccactggggtgtgttatttggcctcgcttactttggtatggcgggaaactgggcaaaggtaatactcatcatgctactcatgtccggcgtcgacgcggaaaccatggccgtcggggctagggccgctcacaccactggcgcccttgtcagcctgctcaatccagggcccagtcagcgcctgcagctgatcaacaccaatgggtcatggcacatcaaccggaccgctttgaactgcaatgactctttgcagacagggttcatagcggccctcttctacacacataggttcaattctagtggctgtcccgagaggatggcttcttgtaaacctctcagtgactttgaccaggggtggggcccgctgtggtacaattcaacagaaagaccttcggaccagcgaccctattgctggcactacgcgccatcgccgtgtggtattgtgccggctaaggatgtttgcggtccggtctactgctttacaccaagcccggttgtggtgggcaccacggatcgccggggggtgcccacgtatacttggggtgaaaatgagtctgatgtcttcctgctcaacagcacaaggccgccgcaaggcagttggtttgggtgctcatggatgaacacaacggggttcacgaagacctgcggaggtcctccgtgcaagatacgtccccagggtgcccagagtaacacctctctcacttgtcccacagactgcttcaggaaacatccgcgtgccacatactccgcttgcggatctggtccgtggttgacacctagatgcatggtccattacccctatagactgtggcactacccgtgtacagtcaacttcaccatacacaaagtcaggttatacatagggggtgtagaacataggctcgatgcagcgtgcaattggacgcggggtgagcgatgcgacctggaggaccgagacagggtggacatgtcccccctgctccattccactacggagctcgcaatacttccgtgttcctttgtgccgcttccggccttatctacgggactgatccacctgcaccaaaacatcgttgacgcccagtacctttatggtctttctcccgctataataagctgggccatcagatgggagtgggtagtcctcgttttcctactcctggcggacgcgcggatctgcgcctgcctttggatgatgatgcttatggcccaggctgaagccgctctggagaacttgatccacctcaacgcggccagccttgcgggaacccatggtatctggtggctccttttagtcttttgtgcctcttggcatctacgaggcagggttgtccctctggtgacgtatgggatatgcgggatgtggcccttcttcctcatgttgctgagcctccccccacgagcgtatgctctggacagggaagtgagcgcagcgttgggaacgggcatgctcgccatcatcctattagttaccttgggaccgcactacaagagacttctagcccttattctctggtgggtcacatatttccttacaaggtgtgaagcagcactccaaacgtgggtccctcctctcaaccctcgggggggcagggacggtttcatcctgtgtgtgctgctgtgctatccaggccttgtctttgacatcacaaaatggttgctggtcatgatgtgccctctctacctcctccagttgtgtttggtgaggactccatactttgtgagggcccaggccctcatcagagtgtgttctctcttcaaaacgctagctgggggacggtacgtgcaggccgcgctgctcactattggccgctggaccggcacttatatttataaccatctcgcccccctggaaacatgggccgccggcggcctacgggatttggccgttgcagtcgagcccgtgatattctcccccatggagaagaagatcatagtttggggggcggagaccactgcttgtggcgacattctttgtggcctgcctgtctcagctcggctcggcagggaagtcctgctagggcccgcggatgactacaggtccatgggatggcaactcctggctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccatggcttccaaggtgtacgaccccgagcaacgcaaacgcatgatcactgggcctcagtggtgggctcgctgcaagcaaatgaacgtgctggactccttcatcaactactatgattccgagaagcacgccgagaacgccgtgatttttctgcatggtaacgctgcctccagctacctgtggaggcacgtcgtgcctcacatcgagcccgtggctagatgcatcatccctgatctgatcggaatgggtaagtccggcaagagcgggaatggctcatatcgcctcctggatcactacaagtacctcaccgcttggttcgagctgctgaaccttccaaagaaaatcatctttgtgggccacgactggggggcttgtctggcctttcactactcctacgagcaccaagacaagatcaaggccatcgtccatgctgagagtgtcgtggacgtgatcgagtcctgggacgagtggcctgacatcgaggaggatatcgccctgatcaagagcgaagagggcgagaaaatggtgcttgagaataacttcttcgtcgagaccatgctcccaagcaagatcatgcggaaactggagcctgaggagttcgctgcctacctggagccattcaaggagaagggcgaggttagacggcctaccctctcctggcctcgcgagatccctctcgttaagggaggcaagcccgacgtcgtccagattgtccgcaactacaacgcctaccttcgggccagcgacgatctgcctaagatgttcatcgagtccgaccctgggttcttttccaacgctattgtcgagggagctaagaagttccctaacaccgagttcgtgaaggtgaagggcctccacttcagccaggaggacgctccagatgaaatgggtaagtacatcaagagcttcgtggagcgcgtgctgaagaacgagcagctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 129 - protein, 3300 aa, Hepatitis C virus
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSSGLYHVTNDCPNSSIVYEAADAILHTPGCVPCVREGNASRCWVAVTPTVATRDGKLPTTQLRRHIDLLVGSATLCSALYVGDLCGSVFLVGQLFTFSPRRHWTTQDCNCSIYPGHITGHRMAWDMMMNWSPTAALVVAQLLRIPQAIMDMIAGAHWGVLAGIAYFSMVGNWAKVLVVLLLFAGVDAETHVTGGNAGRTTAGLVGLLTPGAKQNIQLINTNGSWHINSTALNCNESLNTGWLAGLFYQHKFNSSGCPERLASCRRLTDFAQGWGPISYANGSGLDERPYCWHYPPRPCGIVPAKSVCGPVYCFTPSPVVVGTTDRSGAPTYSWGANDTDVFVLNNTRPPLGNWFGCTWMNSTGFTKVCGAPPCVIGGVGNNTLLCPTDCFRKHPEATYSRCGSGPWITPRCMVDYPYRLWHYPCTINYTIFKVRMYVGGVEHRLEAACNWTRGERCDLEDRDRSELSPLLLSTTQWQVLPCSFTTLPALSTGLIHLHQNIVDVQYLYGVGSSIASWAIKWEYVVLLFLLLADARVCSCLWMMLLISQAEAALENLVILNAASLAGTHGLVSFLVFFCFAWYLKGRWVPGAVYALYGMWPLLLLLLALPQRAYALDTEVAASCGGVVLVGLMALTLSPYYKRYISWCMWWLQYFLTRVEAQLHVWVPPLNVRGGRDAVILLMCVVHPTLVFDITKLLLAIFGPLWILQASLLKVPYFVRVQGLLRICALARKIAGGHYVQMAIIKLGALTGTYVYNHLTPLRDWAHNGLRDLAVAVEPVVFSRMETKLITWGADTAACGDIINGLPVSARRGQEILLGPADGMVSKGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPMASKVYDPEQRKRMITGPQWWARCKQMNVLDSFINYYDSEKHAENAVIFLHGNAASSYLWRHVVPHIEPVARCIIPDLIGMGKSGKSGNGSYRLLDHYKYLTAWFELLNLPKKIIFVGHDWGACLAFHYSYEHQDKIKAIVHAESVVDVIESWDEWPDIEEDIALIKSEEGEKMVLENNFFVETMLPSKIMRKLEPEEFAAYLEPFKEKGEVRRPTLSWPREIPLVKGGKPDVVQIVRNYNAYLRASDDLPKMFIESDPGFFSNAIVEGAKKFPNTEFVKVKGLHFSQEDAPDEMGKYIKSFVERVLKNEQLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 130 - protein, 3300 aa, Hepatitis C virus
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTGPASAYQVRNSTGLYHVTNDCPNSSIVFEAADAILHTPGCVPCVREGNASRCWVAVTPTVATRDGKLPTTQLRRHIDLLVGSATLCSALYVGDLCGSVFLVGQLFTFSPRRHWTTQDCNCSIYPGHISGHRMAWDMMMNWSPTAALLVAQLLRIPQAILDMIAGAHWGVLAGMAYFSMVGNWAKVLVVLLLFAGVDAETYVTGGSAARTTAGLASLFSPGAKQNIQLVNTNGSWHINSTALNCNDSLNTGWIAGLFYHHKFNSSGCSERLASCRPLTDFAQGWGPISHADGSGPDQRPYCWHYPPKPCGIVPAKSVCGPVYCFTPSPVVVGTTDRSGAPTYSWGANDTDVFVLNNTRPPLGNWFGCTWMNSTGFTKVCGAPPCVIGGVGNNTLRCPTDCFRKHPEATYSRCGSGPWITPRCLVDYPYRLWHYPCTINYTVFKVRMYVGGVEHRLEAACNWTRGDRCNLDDRDRSELSPLLLSTTQWQVLPCSFTTLPALSTGLIHLHQNIVDVQYLYGVGSSIASWAIKWEYVVLLFLLLADARVCSCLWMMLLISQVEAALENLVVLNAASLAGTHGLVSFLVFFCFAWYLKGKWVPGAVYALYGMWPLLLLLLALPQRAYALDTEVAASCGGVVLVGLMALTLSPYYKRYISWCLWWLQYFLTRIEAQLHVWIPPLNVRGGRDAVILLMCVVHPALVFDITKLLLAAFGPLWILQASLLKVPYFVRVQGLLRICALARKMAGGHYVQMAIIKLGALTGTYVYNHLTPLRDWAHNGLRDLAVAVEPVVFSRMETKLITWGADTAACGDIINGLPVSARRGREILLGPADGMVSKGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPMASKVYDPEQRKRMITGPQWWARCKQMNVLDSFINYYDSEKHAENAVIFLHGNAASSYLWRHVVPHIEPVARCIIPDLIGMGKSGKSGNGSYRLLDHYKYLTAWFELLNLPKKIIFVGHDWGACLAFHYSYEHQDKIKAIVHAESVVDVIESWDEWPDIEEDIALIKSEEGEKMVLENNFFVETMLPSKIMRKLEPEEFAAYLEPFKEKGEVRRPTLSWPREIPLVKGGKPDVVQIVRNYNAYLRASDDLPKMFIESDPGFFSNAIVEGAKKFPNTEFVKVKGLHFSQEDAPDEMGKYIKSFVERVLKNEQLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 131 - protein, 3300 aa, Hepatitis C virus
MSTNPKPQRKTKRNTNRRPQDVKFPGGGQIVGGVYLLPRRGPRLGVRATRKASERSQPRGRRQPIPKARRPEGRAWAQPGYPWPLYGNEGLGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTIPASAYEVRNVSGIYHVTNDCSNSSIVYEAADVIMHTPGCVPCVQEGNSSRCWVALTPTLAARNASVPTTTIRRHVDLLVGTAAFCSAMYVGDLCGSIFLVSQLFTFSPRRHETVQDCNCSIYPGHVSGHRMAWDMMMNWSPTTALVVSQLLRIPQAVVDMVAGAHWGVLAGLAYYSMVGNWAKVLIVALLFAGVDGETHTTGRVAGHTTSGFTSLFSSGASQKIQLVNTNGSWHINRTALNCNDSLQTGFFAALFYAHKFNSSGCPERMASCRPIDWFAQGWGPITYTKPNSSDQRPYCWHYAPRPCGVVPASQVCGPVYCFTPSPVVVGTTDRSGVPTYSWGENETDVMLLNNTRPPQGNWFGCTWMNSTGFTKTCGGPPCNIGGVGNRTLICPTDCFRKHPEATYTKCGSGPWLTPRCLVDYPYRLWHYPCTLNFSIFKVRMYVGGVEHRLNAACNWTRGERCNLEDRDRSELSPLLLSTTEWQILPCAFTTLPALSTGLIHLHQNIVDVQYLYGVGSAFVSFAIKWEYILLLFLLLADARVCACLWMMLLIAQAEAALENLVVLNAASVAGAHGILSFLVFFCAAWYIKGRLAPGAAYAFYGVWPLLLLLLALPPRAYALDREMAASCGGAVLVGLVFLTLSPYYKVFLTRLIWWLQYFITRAEAHMQVWVPPLNVRGGRDAIILLTCAVHPELIFDITKLLLAILGPLMVLQAGITRVPYFVRAQGLIRACMLVRKVAGGHYVQMVFMKLGALTGTYVYNHLTPLRDWAHAGLRDLAVAVEPVVFSAMETKVITWGADTAACGDIILGLPVSARRGKEIFLGPADSLEGQGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPMASKVYDPEQRKRMITGPQWWARCKQMNVLDSFINYYDSEKHAENAVIFLHGNAASSYLWRHVVPHIEPVARCIIPDLIGMGKSGKSGNGSYRLLDHYKYLTAWFELLNLPKKIIFVGHDWGACLAFHYSYEHQDKIKAIVHAESVVDVIESWDEWPDIEEDIALIKSEEGEKMVLENNFFVETMLPSKIMRKLEPEEFAAYLEPFKEKGEVRRPTLSWPREIPLVKGGKPDVVQIVRNYNAYLRASDDLPKMFIESDPGFFSNAIVEGAKKFPNTEFVKVKGLHFSQEDAPDEMGKYIKSFVERVLKNEQLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 132 - protein, 3306 aa, Hepatitis C virus
MSTLPKPQRKTKRNTIRRPQDVKFPGGGQIVGGVYVLPRRGPRLGVRATRKTSERSQPRGRRQPIPKARRSEGRSWAQPGYPWPLYGNEGCGWAGWLLSPRGSRPSWGPNDPRRRSRNLGKVIDTLTCGFADLMGYIPLVGAPVGGVARALAHGVRALEDGINFATGNLPGCSFSIFLLALFSCLVHPAASLEWRNTSGLYVLTNDCSNSSIVYEADDVILHTPGCVPCVQDDNTSTCWTPVTPTVAVRYVGATTASIRSHVDLLVGAATLCSALYVGDMCGAVFLVGQAFTFRPRRHQTVQTCNCSLYPGHVSGHRMAWDMMMNWSPAVGMVVAHILRLPQTLFDILAGAHWGILAGLAYYSMQGNWAKVAIVMIMFSGVDAETYVTGGSVAHSARGLTSLFSMGAKQKLQLVNTNGSWHINSTALNCNESINTGFIAGLFYYHKFNSTGCPQRLSSCKPIISFRQGWGPLTDANITGPSDDRPYCWHYAPRPCSVVPASSVCGPVYCFTPSPVVVGTTDIKGKPTYNWGENETDVFLLESLRPPSGRWFGCAWMNSTGFLKTCGAPPCNIYGGEGDPENETDLFCPTDCFRKHPEATYSRCGAGPWLTPRCMVDYPYRLWHYPCTVNFTLFKVRMFVGGFEHRFTAACNWTRGERCNIEDRDRSEQHPLLHSTTELAILPCSFTPMPALSTGLIHLHQNIVDVQYLYGVGSDMVGWALKWEFVILVFLLLADARVCVALWLMLMVSQAEAALENLVTLNAVAAAGTHGIGWYLVAFCAAWYVRGKLVPLTIYGLTGLWSLALLVLLLPQRAYAWSGEDSATLGAGVLALFGFFTLSPWYKHWIGRLMWWNQYTICRCEAALQVWVPPLLARGSRDGVILLTSLLYPSLIFDITKLLIAVIGPLYLIQAAITTTPYFVRAHVLVRLCMLVRSVMGGKYFQMAILSIGRWFNTYLYDHLAPMQHWAAAGLKDLAVATEPVIFSPMEIKVITWGADTAACGDILCGLPVSARLGREVLLGPADDYREMGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPMASKVYDPEQRKRMITGPQWWARCKQMNVLDSFINYYDSEKHAENAVIFLHGNAASSYLWRHVVPHIEPVARCIIPDLIGMGKSGKSGNGSYRLLDHYKYLTAWFELLNLPKKIIFVGHDWGACLAFHYSYEHQDKIKAIVHAESVVDVIESWDEWPDIEEDIALIKSEEGEKMVLENNFFVETMLPSKIMRKLEPEEFAAYLEPFKEKGEVRRPTLSWPREIPLVKGGKPDVVQIVRNYNAYLRASDDLPKMFIESDPGFFSNAIVEGAKKFPNTEFVKVKGLHFSQEDAPDEMGKYIKSFVERVLKNEQLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 133 - protein, 3300 aa, Hepatitis C virus
MSTNPKPQRKTKRNTNRRPMDVKFPGGGQIVGGVYLLPRRGPRLGVRATRKTSERSQPRGRRQPIPKARRPEGRSWAQPGYPWPLYGNEGCGWAGWLLSPRGSRPSWGPNDPRRRSRNLGKVIDTLTCGFADLMGYIPLVGAPVGGVARALAHGVRALEDGINYATGNLPGCSFSIFLLALLSCLTVPASAVNYRNVSGIYHVTNDCPNSSIVYEADHHILHLPGCVPCVREGNQSRCWVALTPTVAAPYIGAPLESLRSHVDLMVGAATVCSGLYIGDLCGGLFLVGQMFSFRPRRHWTTQDCNCSIYTGHITGHRMAWDMMMNWSPTTTLVLAQVMRIPTTLVDLLSGGHWGVLVGVAYFSMQANWAKVILVLFLFAGVDAETHVSGAAVGRSTAGLANLFSSGSKQNLQLINSNGSWHINRTALNCNDSLNTGFLASLFYTHKFNSSGCSERLACCKSLDSYGQGWGPLGVANISGSSDDRPYCWHYAPRPCGIVPASSVCGPVYCFTPSPVVVGTTDHVGVPTYTWGENETDVFLLNSTRPPHGAWFGCVWMNSTGFTKTCGAPPCEVNTNNGTWHCPTDCFRKHPETTYAKCGSGPWITPRCLIDYPYRLWHFPCTANFSVFNIRTFVGGIEHRMQAACNWTRGEVCGLEHRDRVELSPLLLTTTAWQILPCSFTTLPALSTGLIHLHQNIVDVQYLYGVGSAVVSWALKWEYVVLAFLLLADARVSACLWMMFMVSQVEAALSNLININAASAAGAQGFWYAILFICIVWHVKGRFPAAAAYAACGLWPLFLLLLMLPERAYAYDQEVAGSLGGAIVVMLTILTLSPHYKLWLARGLWWIQYFIARTEAVLHVYIPSFNVRGPRDSVIVLAVLVCPHLVFDITKYLLAILGPLHILQASLLRIPYFVRAQALVKICSLLRGVVYGKYFQMVVLKAGALTGTYIYDHLTPMSDWAATGLRDLAVALEPVVFTPMEKKVIVWGADTAACGDIIRGLPVSARLGNEILLGPADTETSKGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPMASKVYDPEQRKRMITGPQWWARCKQMNVLDSFINYYDSEKHAENAVIFLHGNAASSYLWRHVVPHIEPVARCIIPDLIGMGKSGKSGNGSYRLLDHYKYLTAWFELLNLPKKIIFVGHDWGACLAFHYSYEHQDKIKAIVHAESVVDVIESWDEWPDIEEDIALIKSEEGEKMVLENNFFVETMLPSKIMRKLEPEEFAAYLEPFKEKGEVRRPTLSWPREIPLVKGGKPDVVQIVRNYNAYLRASDDLPKMFIESDPGFFSNAIVEGAKKFPNTEFVKVKGLHFSQEDAPDEMGKYIKSFVERVLKNEQLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 134 - protein, 3301 aa, Hepatitis C virus
MSTNPKPQRKTKRNTNRRPQDVKFPGGGQIVGGVYLLPRRGPRLGVRATRKTSERSQPRGRRQPIPKARQPTGRSWGQPGYPWPLYANEGLGWAGWLLSPRGSRPNWGPNDPRRKSRNLGKVIDTLTCGFADLMGYIPLVGGPVGGVARALAHGVRVLEDGVNYATGNLPGCSFSIFILALLSCLTVPTSAVPYRNASGVYHVTNDCPNSSIVYEAEDLILHAPGCVPCVRQGNVSRCWVQITPTLSAPSLGAVTAPLRRAVDYLAGGAALCSALYVGDACGAVFLVGQMFTYSPRRHNVVQDCNCSIYSGHITGHRMAWDMMMNWSPTTALVMAQLLRIPQVVIDIIAGAHWGVLFAAAYYASAANWAKVVLVLFLFAGVDASTRTVGGSAAQGARGLASLFTPGPQQNLQLINTNGSWHINRTALNCNDSLQTGFVAGLLYYHKFNSTGCPQRMASCRPLAAFDQGWGTISYAAVSGPSDDKPYCWHYPPRPCGIVPARGVCGPVYCFTPSPVVVGTTDRKGNPTYSWGENETDIFLLNNTRPPTGNWFGCTWMNSTGFVKTCGAPPCNLGPTGNNSLKCPTDCFRKHPDATYTKCGSGPWLTPRCLVHYPYRLWHYPCTLNYTIFKVRMYIGGLEHRLEVACNWTRGERCDLEDRDRAELSPLLHTTTQWAILPCSFTPTPALSTGLIHLHQNIVDTQYLYGLSSSIVSWAVKWEYIVLAFLLLADARICTCLWIMLLVCQAEAALENVIVLNAAAAAGTHGFFWGLLVICFAWHFKGRLVPGATYLCLGIWPLLLLLFLLPQRALALDSSDGGTVGCLVLTILTIFTLTPGYKKMVVLVIWWLQYFIARVEAFIHVWVPPLQVRGGRDAIIMLTCLFHPALGFEVTKILLGILGPLYLLQYSLIKLPYFIRARALLRACLLAKHLACGRYVQAALLHLGRLTGTYIYDHLAPMKDWAASGLRDLAVATEPIIFSPMETKVITWGADTAACGDILAGLPVSARRGHEIFLGPADDIREAGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPMASKVYDPEQRKRMITGPQWWARCKQMNVLDSFINYYDSEKHAENAVIFLHGNAASSYLWRHVVPHIEPVARCIIPDLIGMGKSGKSGNGSYRLLDHYKYLTAWFELLNLPKKIIFVGHDWGACLAFHYSYEHQDKIKAIVHAESVVDVIESWDEWPDIEEDIALIKSEEGEKMVLENNFFVETMLPSKIMRKLEPEEFAAYLEPFKEKGEVRRPTLSWPREIPLVKGGKPDVVQIVRNYNAYLRASDDLPKMFIESDPGFFSNAIVEGAKKFPNTEFVKVKGLHFSQEDAPDEMGKYIKSFVERVLKNEQLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 135 - protein, 3306 aa, Hepatitis C virus
MSTLPKPQRKTKRNTNRRPMDVKFPGGGQIVGGVYLLPRRGPRLGVRATRKTSERSQPRGRRQPIPKARQPQGRHWAQPGYPWPLYGNEGCGWAGWLLSPRGSRPHWGPNDPRRRSRNLGKVIDTLTCGFADLMGYIPVVGAPLGGVAAALAHGVRAIEDGINYATGNLPGCSFSIFLLALLSCLTTPASALTYGNSSGLYHLTNDCPNSSIVLEADAMILHLPGCLPCVRVNNNQSICWHAVSPTLAIPNASTPATGFRRHVDLLAGAAVVCSSLYIGDLCGSLFLAGQLFTFQPRRHWTVQDCNCSIYTGHVTGHRMAWDMMMNWSPTTTLVLSSILRVPEICASVIFGGHWGILLAVAYFGMAGNWLKVLAVLFLFAGVEATTTIGHQVGRTTGGLASLFSIGPRQNLQLINTNGSWHINRTALNCNDSLQTGFITSLFYAKNVNSSGCPERMAACKPLADFRQGWGQITYKVNISGPSDDRPYCWHYAPRPCDVVSARTVCGPVYCFTPSPVVVGTTDKLGIPTYNWGENETDVFMLESLRPPTGGWFGCTWMNSTGFTKTCGAPPCQIVPGDYNSSANELLCPTDCFRKHPEATYQRCGSGPWITPRCLVDYPYRLWHYPCTVNFTLHKVRMFVGGIEHRFDAACNWTRGERCDLHDRDRIEMSPLLFSTTQLAILPCSFSTMPALSTGLIHLHQNIVDVQYLYGVSSSVTSWVVKWEYIVLVFLVLADARICTCLWLMLLITNVEAAVERLVVLNAASAAGTAGWWWAVLFLCCAWYVKGRLVPACTYMALGMWPLLLTILALPRRAYAMDNEQAASLGAVGLLVLTIFTITPMYKKLLTCSIWWNQYFLARAEAMIHEWVPDLRVRGGRDSIILLTCLLHPQLGFEVTKILLAILAPLYILQYSLLKVPYFVRAHVLLRACLLVRRLAGGKYVQACLLRLGAWTGTFVYDHLAPLSDWASDGLRDLAVAIEPVIFSPMEKKIITWGADTAACGDILSGLPVSARLGNLVLLGPADDMQRGGWKLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPMASKVYDPEQRKRMITGPQWWARCKQMNVLDSFINYYDSEKHAENAVIFLHGNAASSYLWRHVVPHIEPVARCIIPDLIGMGKSGKSGNGSYRLLDHYKYLTAWFELLNLPKKIIFVGHDWGACLAFHYSYEHQDKIKAIVHAESVVDVIESWDEWPDIEEDIALIKSEEGEKMVLENNFFVETMLPSKIMRKLEPEEFAAYLEPFKEKGEVRRPTLSWPREIPLVKGGKPDVVQIVRNYNAYLRASDDLPKMFIESDPGFFSNAIVEGAKKFPNTEFVKVKGLHFSQEDAPDEMGKYIKSFVERVLKNEQLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 136 - protein, 3304 aa, Hepatitis C virus
MSTNPKPQRLTKRNTVRRPQNVKFPGGGQIVGGVYLLPRRGPRLGVRGTRKSSERSQPRGRRQRIPKAASSQGKAWGKPGYPWPLYGNEGCGWAGWLLSPRGSRPTWGPTDPRHRSRNLGKVIDTMTCGFADLMGYIPVLGAPLGGVARALAHGVRVLEDGVNYATGNLPGCSFSIFLLALLSCLTVPASAYEVRNSSGVYHLTNDCPNASIVYETDNAILHEPGCVPCVREGNTSRCWEPVAPTLAVRYRGALTDDLRTHIDLVVASATLCSALYVGDICGAIFIASQAVLWKPGGGRIVQDCNCSIYPGHVTGHRMAWDMMQNWAPALSMVAAYAVRVPGVIITTVAGGHWGVLFGLAYFGMAGNWAKVILIMLLMSGVDAETMAVGARAAHTTGALVSLLNPGPSQRLQLINTNGSWHINRTALNCNDSLQTGFIAALFYTHRFNSSGCPERMASCKPLSDFDQGWGPLWYNSTERPSDQRPYCWHYAPSPCGIVPAKDVCGPVYCFTPSPVVVGTTDRRGVPTYTWGENESDVFLLNSTRPPQGSWFGCSWMNTTGFTKTCGGPPCKIRPQGAQSNTSLTCPTDCFRKHPRATYSACGSGPWLTPRCMVHYPYRLWHYPCTVNFTIHKVRLYIGGVEHRLDAACNWTRGERCDLEDRDRVDMSPLLHSTTELAILPCSFVPLPALSTGLIHLHQNIVDAQYLYGLSPAIISWAIRWEWVVLVFLLLADARICACLWMMMLMAQAEAALENLIHLNAASLAGTHGIWWLLLVFCASWHLRGRVVPLVTYGICGMWPFFLMLLSLPPRAYALDREVSAALGTGMLAIILLVTLGPHYKRLLALILWWVTYFLTRCEAALQTWVPPLNPRGGRDGFILCVLLCYPGLVFDITKWLLVMMCPLYLLQLCLVRTPYFVRAQALIRVCSLFKTLAGGRYVQAALLTIGRWTGTYIYNHLAPLETWAAGGLRDLAVAVEPVIFSPMEKKIIVWGAETTACGDILCGLPVSARLGREVLLGPADDYRSMGWQLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPMASKVYDPEQRKRMITGPQWWARCKQMNVLDSFINYYDSEKHAENAVIFLHGNAASSYLWRHVVPHIEPVARCIIPDLIGMGKSGKSGNGSYRLLDHYKYLTAWFELLNLPKKIIFVGHDWGACLAFHYSYEHQDKIKAIVHAESVVDVIESWDEWPDIEEDIALIKSEEGEKMVLENNFFVETMLPSKIMRKLEPEEFAAYLEPFKEKGEVRRPTLSWPREIPLVKGGKPDVVQIVRNYNAYLRASDDLPKMFIESDPGFFSNAIVEGAKKFPNTEFVKVKGLHFSQEDAPDEMGKYIKSFVERVLKNEQLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

The invention claimed is:

1. A chimeric nucleic acid molecule comprising the structural genes Core, E1, and E2, the p7 gene, and the non-structural gene NS2 of any one of a genotype 1a, 1b, 2a, 2b, 3a, 4a, 5a, 6a, or 7a Hepatitis C virus (HCV) and the non-structural genes NS3, NS4A, NS4B, NS5A and NS5B from the HCV genotype 2a JFH1 strain, wherein a reporter gene is inserted in domain III of the non-structural gene NS5A, wherein said NS5A gene encodes a non-structural NS5A protein having a 40 amino acid deletion of amino acid positions 250 to 289 or having a 25 amino acid deletion of amino acid positions 266-290, and wherein said nucleic acid encodes an intragenotypic or intergenotypic recombinant HCV genome that is infective and genetically stable in cell cultures.

2. The nucleic acid molecule according to claim 1, wherein the genotype 1a is of the strain H77, TN or DH6, wherein the genotype 1b is of the strain J4, DH1, or DH5, wherein the genotype 2a is of the strain J6 or JFH1, wherein the genotype 2b is of the strain J8, wherein the genotype 3a is of the strain S52 or DBN, wherein the genotype 4a is of the strain ED43, wherein the genotype 5a is of the strain SA13, wherein the genotype 6a is of the strain HK6a, wherein the genotype 7a is of the strain QC69.

3. The nucleic acid molecule of claim 1, wherein the reporter gene is an EGFP reporter gene.

4. The nucleic acid molecule of claim 1, which encodes human hepatitis C virus of strain selected from the group consisting of:

HCV genotype 1a/JFH1-hRLucΔ, HCV genotype 1b JFH1-hRlucΔ, HCV genotype 2a/JFH1-hRlucΔ, HCV genotype 2b/JFH1-hRlucΔ, HCV genotype 3a/JFH1-hRlucΔ, HCV genotype 4a/JFH1-hRlucΔ, HCV genotype 4b/JFH1-hRlucΔ, HCV genotype 5a/JFH1-hRlucΔ, HCV genotype 6a/JFH1-hRlucΔ, and HCV genotype 7a/JFH1-hRlucΔ, wherein HCV genotype 1a/JFH1-hRLucΔ encodes the amino acid sequence with a sequence identity of at least 95% to that of SEQ ID NO: 130, wherein HCV genotype 1b/JFH1-hRLucΔ encodes the amino acid sequence with a sequence identity of at least 95% to that of SEQ ID NO: 131, wherein HCV genotype 2a/JFH1-hRlucΔ encodes the amino acid sequence with a sequence identity of at least 95% to that of SEQ ID NO: 20, wherein HCV genotype 2b/JFH1-hRlucΔ encodes the amino acid sequence with a sequence identity of at least 95% to that of SEQ ID NO: 103, wherein HCV genotype 3a/JFH1-hRlucΔ encodes the amino acid sequence with a sequence identity of at least 95% to that of SEQ ID NO: 132, wherein HCV genotype 4a/JFH1-hRlucΔ encodes the amino acid sequence with a sequence identity of at least 95% to that of SEQ ID NO: 133, wherein HCV genotype 5a/JFH1-hRlucΔ encodes the amino acid sequence with a sequence identity of at least 95% to that of SEQ ID NO: 134, wherein HCV genotype 6a/JFH1-hRlucΔ encodes the amino acid sequence with a sequence identity of at least 95% to that of SEQ ID NO: 135, and wherein HCV genotype 7a/JFH1-hRlucΔ encodes the amino acid sequence with a sequence identity of at least 95% to that of SEQ ID NO: 136.

5. The nucleic acid molecule according to claim 4, which encodes human hepatitis C virus of strain selected from the group consisting of:

HCV genotype 1a/JFH1-hRLucΔ, HCV genotype 1b/JFH1-hRlucΔ, HCV genotype 2a/JFH1-hRlucΔ, HCV genotype 2b/JFH1-hRlucΔ, HCV genotype 3a/JFH1-hRlucΔ, HCV genotype 4a/JFH1-hRlucΔ, HCV genotype 4b/JFH1-hRlucΔ, HCV genotype 5a/JFH1-hRlucΔ, HCV genotype 6a/JFH1-hRlucΔ, and HCV genotype 7a/JFH1-hRlucΔ, wherein HCV genotype 1a/JFH1-hRLucΔ encodes the nucleic acid sequence with a sequence identity of at least 95% to that of SEQ ID NO: 122;

wherein HCV genotype 1b/JFH1-hRlucΔ (1b/2a) encodes the nucleic acid sequence with a sequence identity of at least 95% to that of SEQ ID NO: 123;

wherein HCV genotype 2a/JFH1-hRlucΔ encodes the nucleic acid sequence with a sequence identity of at least 95% to that of SEQ ID NO: 10, wherein HCV genotype 2b/JFH1-hRlucΔ encodes the nucleic acid sequence with a sequence identity of at least 95% to that of SEQ ID NO: 83, wherein HCV genotype 3a/JFH1-hRlucΔ encodes the nucleic acid sequence with a sequence identity of at least 95% to that of SEQ ID NO: 124, wherein HCV genotype 4a/JFH1-hRlucΔ the nucleic acid sequence acid sequence with a sequence identity of at least 95% to that of SEQ ID NO: 125, wherein HCV genotype 5a/JFH1-hRlucΔ the nucleic acid sequence acid sequence with a sequence identity of at least 95% to that of SEQ ID NO: 126, wherein HCV genotype 6a/JFH1-hRlucΔ the nucleic acid sequence acid sequence with a sequence identity of at least 95% to that of SEQ ID NO: 127, and wherein HCV genotype 7a/JFH1-hRlucΔ the nucleic acid sequence acid sequence with a sequence identity of at least 95% to that of SEQ ID NO: 128.

6. The nucleic acid molecule according to claim 2, wherein the reporter gene is an EGFP reporter gene.

7. The isolated nucleic acid molecule according to claim 1, wherein said nucleic acid molecule encodes a Hepatitis C virus that is capable of infectivity in vivo.

8. The nucleic acid molecule according to claim 1, wherein said molecule comprises one or more adaptive mutations in Core, E1, E2, p7, NS2, NS3, NS4A, NS4B, NS5A or NS5B singly or in combination.

9. The nucleic acid molecule according to claim 1, wherein said molecule is capable of generating a HCV RNA titer not represented by input of said molecule itself of $10^4$ IU/ml or above following transfection and/or subsequent viral passage.

10. The nucleic acid molecule according to claim 1 wherein said molecule is capable of generating a HCV infectivity titer of $10^2$ TCID$_{50}$/ml (50% tissue culture infectious doses)/ml or above following transfection and/or subsequent viral passage.

11. A method for producing a cell which replicates HCV RNA and produces a virus particle comprising introducing a nucleic acid molecule according to claim 1 into a cell.

12. The method according to claim 11, wherein the cell is Huh7.5.

13. An isolated cell comprising the nucleic acid molecule of claim 1.

14. A hepatitis C virus particle comprising the nucleic acid molecule of claim 1.

* * * * *